United States Patent 11,446,398 (REGULATED BIOCIRCUIT SYSTEMS) - sequence listing, part 79

SEQ ID NO: 182275 - DNA, 4688 bp, Homo sapiens
  Payload ID: 15893
  Gene Symbol: SMIM13
  Gene Name: small integral membrane protein 13
  Uniprot ID: P0DJ93
  ENST ID: ENST00000416247
  CDS Start-End: 282-557
ctccggggcgatgagggactagaggcgccctgaggcccgcctgcctcccgcgctctggccaccccggcgggaaaaggatcgggcgggcgggcggtcccacagtgcccgcctttgcgccgccccaccccctgggggcgctgccgagggggcgccagccgcccatgccgccccggcgcccagccgcgcctggcgcccgccgctgaagcgcaggacgcgccgccgcccgcgctcaccgccgtccgcgccagccgccccgagccgactgcccttctgcccccaagatgtggcacagcgtcgggctgactctgcttgtgttcgtggccacgctgctgatcgtcctgctgctgatggtgtgcggttggtattttgtatggcatctttttttatcaaaattcaagtttctccgggaactggtgggagacacaggatcccaagagggagatcatgagccttcagggtctgaaactgaagaagacacttcctcctctccacacagaatcagatccgctcgccaaaggagggcacctgctgatgaaggccacagacccctgacatagtcctgtacttgtgaaggatgaaaaggcagttgccagcttctgtcttttactgacttcgctttgaaatttactaatgactgaagaacatttgtattggattttaagtcgaattttaaaaaagatttacatgtaagccatataaaaataaagggaactgaaaccaaattggactattataaatttcatcttaaagataatcttttgtttcaccagctttctacttatacacttattccttggcttttgggcttattttcttgcactggtgcagatctggtaaacattaaaggcttgaaaaaccatattttgttagccctaaaatgtacatttttcttcccattttaacttatctgaaattgggatgcatctcattactgtcaaccaggtgatagtcatgtaacgctcctaccgtgtgcatgtgtgaatttacagcttgtcatcgtgtcatccctttaaccaacatgtgttttgttggtatcaaatgtgtcaggtttaattgacattttaaaatgtcttcaaaaagatcacactatgattcagcattgaaacgaaaagttattgtgtatgcagaaaagcatggaaacagagcagcagggcgtacatttgatattagtgaagcaaatattcgtcgctggagaaatgatcgcaattccatattttcctgcaaagcaacaacaaaatgttttacgggacctaagaaaggtaggtacccacaagtagatgaagctgtactacgtttcgtcagtgagacacgtgcaaaaggattgcctatcacacgccaagcaatgcaattgaaggcaggagaagttgccaaaaccctaggaattgatgaaacaaaattcaaagccacaagaggctggtgtgaccgattcatgcgtcgagcaggactatcattaaggcatcaaacatcgttttgtcccaagctccccactgccattaaacagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtgatatgaaagcattgtgtcatagtttaatgggcagtgttttttcttagtgatacatatggtgcatcttaacaattggtagtgtcttaggttaaattaaaaatggtagcttgtaaatttatttttctttttaagatagcagttatttattggggaatttgattctgactcttacaatgttaaacttgtaatcctgtgtgaaacacatgtttttgggggggagggggtaaccaagatttcagggtagtaacttaggaatctaagaactatcttctactttaggaagagtgggattagttactccctttgtataggaggactttatgctcaaggaatgtgttgtggagaaaaacacttcttcacaaacaattcagtgacaagacctcaaaggtaatgcgtattgaggaaaacagtagtgggtgaaaattcccgcttagctgtaaaatgactctcttgccaggtttccgtgtttgtctcaactgaactctgggctgagtgtttaccagggagaagagatgtgaattaaacaaccttcctgtttagtgttacctgctttgtacaagaatgaagtgcaaagccaacttactttattaatccaagttctttttatgtttttcttaacctttattaaggactagtcatcacaaaatatctatttaacctctattttatgatggtgtgttattatgtttgatacctcatacttcttgcttagagttttgtttaacagttcactggctctgtcccaatgtttgtgatgaacacctttttgctatattgtagctcttggagatactaaaagagaattcacagaacataactttagttttatgtgtttgctaggggaagatttcctagcagctgagagcaaggcacagtctctgtcttcatttctttattagatacaattttctatttttatgtgactctagggcataacaaaacagtgacagtttcaagcgttaattttaatgcttcctactagctaaatatcatcttaaaatgattatcagaaaaaaaaataatgcccccaaaaacttttgggggcattatttggtactgggaggatatttaaattagatttttcatagtctattgttttgaactatggattctgttttatggtggatacctaaggtttatataatagttgctggaaaacttaaagtagctggtgagcttcctgttatgtcactattaaagaatgatggctgatgtaactctgcccctgaaatctacaagggtcatgcccaaattaatacaggttaacctttgtagaggtatatatgttggcattatttattgacatttatgcttcaagcatgtcttattttatgtaattttaagaaatactctatttaacttgtgaaatatacctaaaagcatactagttagctcttagactctcacttagggagggtaaagaaacatcactgatgccaatatgaagatctataaacaaatcctttgtttagaacttttttctcttcgtgcacctcacaacacacttaccatggtacatatttcttaatgccactaagaaaggcaagatagtgaacgcagaattatttatgtggtatagtgtttgttttcctgttttagtgcttttgtagctaaaacttactggaactgcatcacaactacatttgcagtctcagtgggaggtggactagcctgtggttaattttagagcttaaaagtttataagcattaaaaacacatacatgtattagaatcttgtctaacccctcacaaaggatgatggtgatcagcatgccatcttttgaagattaattctaaaattgaggactctggtaggttgttttatttccttcccaaccagccattcatttccaattgttctgcctttgaaactttttgtgaaaattgcctgtaccaattgcattggttgcgttgctctgatttaaatgccaaaaacactaaatatttgtgtagtgctgttaaatgaggtttttgatatttccatcaaaatgaatataaaattcacttgatggattttgtagtgatgttttcacagttgaaacaaacatattgctgtgcggtggacagccacttcacagacatgcagacccatttctttagagatattaggtttaaaacccattttaattttattttgctgaaggtttggaatatataaagtaatggattcacaaaatatgatatcttaaaacatgttgaaagatttgaaagtggtgcatttttacttttaagagcagcaatctttgaaattagtcaacaatgcagtcttttttaaaagtcagttttctcaagtagtatgttgtaacgtaagatgtaactgatataactagattttgactggtaaacttaaagtgctttttatatttgaggttgactttaaaaagccattgagcagtcctcagaggttatggactctcaagcgactaatggaatagtgttctgttgtgaagtctagaactaaagcaccttgtattgtctgcttctaaagtgtcctatagtttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaataggtttataaataattagaattacgtgttttaatagtacctttgtatatataacaagatgtaaaattaaagatgaggaatgtgtgtaaatgatcattcactgtttttgttttaaaactggtcagtactatgaagcttctgtggtttgtatgatgttttaactttcactttaaactgcatagaataaattaaattgaaaacaa

SEQ ID NO: 182276 - DNA, 1251 bp, Homo sapiens
  Payload ID: 15893
  Gene Symbol: SMIM13
  Gene Name: small integral membrane protein 13
  Uniprot ID: P0DJ93
  ENST ID: ENST00000376935
  CDS Start-End: 84-359
gctgaagcgcaggacgcgccgccgcccgcgctcaccgccgtccgcgccagccgccccgagccgactgcccttctgcccccaagatgtggcacagcgtcgggctgactctgcttgtgttcgtggccacgctgctgatcgtcctgctgctgatggtgtgcggttggtattttgtatggcatctttttttatcaaaattcaagtttctccgggaactggtgggagacacaggatcccaagagggagatcatgagccttcagggtctgaaactgaagaagacacttcctcctctccacacagaatcagatccgctcgccaaaggagggcacctgctgatgaaggccacagacccctgacatagtcctgtacttgtgaaggatgaaaaggcagttgccagcttctgtcttttactgacttcgctttgaaatttactaatgactgaagaacatttgtattggattttaagtcgaattttaaaaaagatttacatgtaagccatataaaaataaagggaactgaaaccaaattggactattataaatttcatcttaaagataatcttttgtttcaccagctttctacttatacacttattccttggcttttgggcttattttcttgcactggtgcagatctggtaaacattaaaggcttgaaaaaccatattttgttagccctaaaatgtacatttttcttcccattttaacttatctgaaattgggatgcatctcattactgtcaaccaggtaggtacccacaagtagatgaagctgtactacgtttcgtcagtgagacacgtgcaaaaggattgcctatcacacgccaagcaatgcaattgaaggcaggagaagttgccaaaaccctaggaattgatgaaacaaaattcaaagccacaagaggctggtgtgaccgattcatgcgtcgagcaggactatcattaaggcatcaaacatcgttttgtcccaagctccccactgccattaaacagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtga

SEQ ID NO: 182277 - DNA, 6483 bp, Homo sapiens
  Payload ID: 15894
  Gene Symbol: SMIM14
  Gene Name: small integral membrane protein 14
  Uniprot ID: Q96QK8
  ENST ID: ENST00000295958
  CDS Start-End: 388-687
acgcacagcgtgtcgtaggcgtccgaagccgcaggctcccgcccggcttcccgggacgcacagggcaggcgctgggcatgcgcatgctcggcaggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcacttaaaaatgtctgcatgggctgggcacggtggctcacgcctgtaatcccagcactttgggaggccgaggcaggcgaatcacctgaggtcaggagttcgagaccagcctgaccaacatggtgaaaccttatctctactaaaaatgcaaaaattagccaggcatggtggtgtgtgcctataatcccagctactggggaagctgaggcaggaaattgcttgaacctgggagacggaggttgcagtaagctgagatcgtgccactgcactccaatcagggcgacagagcgagactctgtctcaaaataaataaataaataaaaatgtctgcatgacccatatggttatgaagtttttttcctagcaaatgattgcagattatttatgggggctagaagatattttgctatcaatgtaaggatttttttccccttaggtcagtctattcactgtttagatctggtaaattacttgtatgaattgaataaattctctgtatcattgtactgtttaatagtctctgatacaattgtgatactcataaggtattttcccccctttattatgattacattctagatcataaacattgtaagggcatcttttcattatataatccaatattgattgtttgaattcctccttgtacatcctggctttgtgctcaatttcttgaaataatataaccaactctaaattacttgtgttaatagatcggtaacatgacacaggtaagttaaatcctggataaatgagccccacagaataaaggtttttcctcttgctgtggcctactggaagccttcctaactctatagctggtaaagtagagcagaaagggccagaatggcttaagatggagctaaatccctatagcattccattttctgctcttgcctcttgaacttagaaggcttgcccatatatcctaacaatctgttctctgagctgttaggccaatccctggcaagagatattgatgtagtcactgaatctatggctcacaaataattgaaaattggctttgggagctgggcgcagtgactcatgcctgtaatcccagcactttgggaggctggggcaggtggatcacttgaggtcaggaggttgagaccagcctggccaagacggtgaaaccccgtgcctacaaaaaattagccgggtttggtgacacggcctgtagtcttagctactcgggaggctgaggcaggagaatcgcttgagcctgggagacaggttgcagtaagccaagatcacgccactgcactccagcttgagtgacagagtgagaccctgtctcaaaaaaaaaaggctttagaaggctttattggatgaaatggctgaaacttggatacagaatgtctagtattagacacctaaaaatctggattctttttggttgttgttttgagatggagttttgctctttcgcccaagctggagtgaagtggcgcgaccttggctcactgcaacatccacccccaggttcgagcgattctccttcctcagcctcctgagtagctgggattataagtgcccaccaccacgcccagctaatttttgtatctttagtagagatggggtttcgccatgtaggccaggctggtctcaaactcctgacctcaggtgatccacccactatggcctcccaaagtgctaggattacagatgtgagccaccgtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaagtgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattagtttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaacactttgtgttttctgtttggcttttgtgggaagagaagcaagcatcttttgcctagtagatgttaacattgtgtattaaacagtttctttgtaagacctaactaaagacattcctaagagagaacttaagttttaagaaaagttgtgagaaaaatattcataaaatatgcagtatggggccagtattcagaagtagagtttctctcttggaaattagattgcagtcacatttctttggttattttctttctctctctcttcctagaataccaggtaaaatagacatttactttgagggactaatatccaatagtgttaattatttaagcagatatatctagctcaaaaggaaccagacatgtcactgtaccaaaaacacacaaaagtgaaaatttgcttctgttctgtgacctagaatgtgtccagacattaaaggtcatgaatactcatatacatgtaaaaatagtaacactgctctggcatgattttgacgtcagtgtttatgtaataacttcagtgttatatttaaaatagataaatttgtgaaataacaatttcttggagacagtcaactttttatgatttaatctaaagattgtcatgtacatgtcaacggatatctgaatcctcagtgaaactgttaagttttcattaaatgactctgctgcaatactagttttcttctcagaaaatggaattcaaataaaataagttttttggtcttggcatttcacctgatgactttctctgttctggatctcaatttgtagagttgttgggggttcccccccctccaaaagatgctccataaacaccaactacaattatctttcatgatcatatttttaaaaattggagttacctgtgtgatcttttcccattagttgcttgtaggggactttagtgtgcgtatctcttctcagacaaatgtattatgttcgttcaataaacacttcaacaaattttta

SEQ ID NO: 182278 - DNA, 830 bp, Homo sapiens
  Payload ID: 15894
  Gene Symbol: SMIM14
  Gene Name: small integral membrane protein 14
  ENST ID: ENST00000511809
  CDS Start-End: 191-355
caaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttacctt

SEQ ID NO: 182279 - DNA, 612 bp, Homo sapiens
  Payload ID: 15894
  Gene Symbol: SMIM14
  Gene Name: small integral membrane protein 14
  ENST ID: ENST00000505729
  CDS Start-End: 345-612
cactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcgggtgttgacagagtggcctcagacaaaactgtgaagtagagtttgcatatggtgttgcttaccttctggaaagtgagcctctccagctcaggccgcatctccatctccctttccaattctcacctccccttctccccttagctcagatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatg

SEQ ID NO: 182280 - DNA, 680 bp, Homo sapiens
  Payload ID: 15894
  Gene Symbol: SMIM14
  Gene Name: small integral membrane protein 14
  ENST ID: ENST00000507613
  CDS Start-End: 143-259
gcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgtaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtt

SEQ ID NO: 182281 - DNA, 2889 bp, Homo sapiens
  Payload ID: 15895
  Gene Symbol: SMIM15
  Gene Name: small integral membrane protein 15
  Uniprot ID: Q7Z3B0
  ENST ID: ENST00000339020
  CDS Start-End: 427-651
acttccgccttcctgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaagaggtcctggattttttttttttttttggaggaactaacattttaagttacattatgttatgcaagttagaatttcagttacagctaagcatacttgtaaaatttcaggactgtatctctcagaacctaaggaccactgagaatgtttatggaccagtttgaataacacttaatgctattcttttagattatcagtctctacttggtgccagtgtgagcaacacattataactcaaggcactgaaattattcagtgttaagatatatctataatatgtttggttttctgcaatcaagctgttcatggaaagaatttatgtacatgttttacttagggtcacattttagagtaaaagtattgaagcaaaggatatagtcataattctcagttacctactaaagttatggtttcatcagttctgttgtaacaacttaaaggtatttaaaggtctgtttttctataatttattagtcttaacacatgccagttttgtatttgtttgacatatgctttttttttccacttttttccatcatttagagagcctttctatatatgtgagattcatactttacagtgtgtgtgtgtgtgtgtgtgtgtgtgtgtgtgtaaggggctggagtatagagaatattgtgaggtttgggattcttcagaaaaatcacctctcactgcaacagagtactgttgttaaagaatcccatttgctattatctagaatacttttaagaaattgtttacttattacattgtttctgaagttctgagaactaagtacaatcaattaccattctaaagctggtcttgggggagaaagaaagctgtcccctggctgcctctaacaaacattttatcaaaaatcagcaaataaataaaagtttgtatgtcagaa

SEQ ID NO: 182282 - DNA, 584 bp, Homo sapiens
  Payload ID: 15895
  Gene Symbol: SMIM15
  Gene Name: small integral membrane protein 15
  Uniprot ID: Q7Z3B0
  ENST ID: ENST00000507416
  CDS Start-End: 335-559
gccttcctgcttccggtctggcgcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccag

SEQ ID NO: 182283 - DNA, 1076 bp, Homo sapiens
  Payload ID: 15896
  Gene Symbol: SMIM17
  Gene Name: small integral membrane protein 17
  Uniprot ID: P0DL12
  ENST ID: ENST00000598409
  CDS Start-End: 167-523
gtctgcgcagccgcagtcagtgcggcgccagctctgcagagcccagacagggtccggttggggaggtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaagacctgtcttctcaagagactgggctttcccaggagtggagctcggtggaggaagatgacgaatcagagggctcccagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaaaaaatttttggtgtgagttttcacatactttatttccatgaaatgaagacatcattgattgtaaaacattattttgtataccacggagaaagaaaagtgctaattaatcattaagatgccaccaactggaagatatctcctgactttgagaagatgaaaaaatgtgcaactgaagatcaatgaaatctggtacatttcctaacatcaaaccaactttgcattcttaaggttttggtgcaccagtcttttcatacactagattatatttattgatattttatgtaggattcttgcctctatcttcacatgtgagattggtgctatctttgtgaagttttggtatcatggttaagcttgcatcatagaaagacttgggtaacttttaccttttctatgcttttcaatagt

SEQ ID NO: 182284 - DNA, 573 bp, Homo sapiens
  Payload ID: 15896
  Gene Symbol: SMIM17
  Gene Name: small integral membrane protein 17
  ENST ID: ENST00000600547
  CDS Start-End: 149-460
agtgcggcgccagctctgcagagcccagacagggtccggttggggaggtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaa

SEQ ID NO: 182285 - DNA, 905 bp, Homo sapiens
  Payload ID: 15897
  Gene Symbol: SMIM18
  Gene Name: small integral membrane protein 18
  Uniprot ID: P0DKX4
  ENST ID: ENST00000517349
  CDS Start-End: 151-438
gacgataccatcgcttcagcagcatcctctcagacaagagccactatttctgattcagatcacctgtcatcgaagtttaaagaaggggaaacaggagacagaaatacactgaaccaaaaagattcaaaagagcaagtggaatctctaagaatggcttccagccactggaatgaaaccactacctctgtttatcagtaccttggttttcaagttcaaaaaatttaccctttccatgacaactggaacactgcctgctttgtcatcctgcttttatttatatttacagtggtatctttagtggtgctggctttcctttatgaagtgcttgactgctgctgctgtgtaaaaaacaaaaccgtgaaagacttgaaaagtgaacccaaccctcttagaagtatgatggacaacatcagaaaacgtgaaactgaagtggtctaacactctatagaagatgaacaaaatctctgaaagcagctcaacctcttctgagaaaaaaaatatattctgaggccaactgttgctacaaaacaaattctgactgaatggttaaaacatttctagtagaaggggaaaaaaaagttaaacatgcactgtttgtgtgtatagccatttcattaaatatacagtaaaacttcatgaatgtgaatttactaatctgtttaatactgacacttcaaaaactggataaaagattcctagagttcaatattaagcagcaaaagataagctggaaaagacaagcaaggctaatgatgctaaaatgattttataactaaccaattcatgtagacaaaaaatagtgtgttggtaacaaaaaggctatttaaaacatgtttctaagtctgaagtaaaatacttccacttatatatataaagttcctatttattaaaaagtagtattttct

SEQ ID NO: 182286 - DNA, 114 bp, Homo sapiens
  Payload ID: 15897
  Gene Symbol: SMIM18
  Gene Name: small integral membrane protein 18
  ENST ID: ENST00000626298
  CDS Start-End: 1-114
aacccgtttctactaaaaatacaaaaattagccaggaggcggaggttgcaatcacctgtcatcgaaaagatgaacaaaatctctgaaagcagctcaacctcttctgagaaaaaa

SEQ ID NO: 182287 - DNA, 691 bp, Homo sapiens
  Payload ID: 15898
  Gene Symbol: SMIM19
  Gene Name: small integral membrane protein 19
  Uniprot ID: Q96E16
  ENST ID: ENST00000416469
  CDS Start-End: 368-691
cgcgggggtaaggggggtggccgcccgcctgccctcggtcccgtgcggtccccgaaactccgagcacccgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatga

SEQ ID NO: 182288 - DNA, 2958 bp, Homo sapiens
  Payload ID: 15898
  Gene Symbol: SMIM19
  Gene Name: small integral membrane protein 19
  Uniprot ID: Q96E16
  ENST ID: ENST00000438528
  CDS Start-End: 50-373
accccaagcgcgcacagcggagcaggaggcgcccggcactcgcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataacttcctgtttcattgtattctgtgagtgataagtgtcagatcaataacagattaatttgttgttaacagctctttttttttttttttttttgagacagagtctgttgcccagactggagtgcagtggcacaatctctgctcactgcaacttccacctcccgggtttaaacgattctcctgccacagcctcctgaatattctgttaacagctctttaattaatgatctttgcttcttcagaacttgtatggtagaccgtcttttctacagcatgatgcatactcctgtgctaattttagaagctttctgtaactagatttttcctcattatgctcccaggagcgagtttgtttttatccccgtttcatttctaccaggtagctctactttaggccatactggggacctgctgttgaataaatggatgcctgtgtattggtgttggcaactctgcggtagtagtgctaccactggcgaggcagtattactgccactggtgaatgttgctgtctggttactgctgcatttttggcatgctaagctttcctaaagagcctcatatcttttcccatgctgtactgtacaatgaaatgtttttacctaatttttcatgtttatttaaataaaagctgactgggtaatagtggggaagtttaattgtccacataagtcaaaagaatccgtttttgaactagagctattttcaattataagagtgagctggctgggcacggtggctcacgcctgaaatcccagcactttgggaggccaaggtgggaggatcacgaggtcaggagtttgagaccagcctggccaacgtggttaaacccaatctctacgaagaatacaaaaattcgctgggtgtggtggcatgcgcctgtaatcccagctactcaggaggctgaggcaggagaattgctcgaatctgagaggtggaggttgcaatgagccaagatcacaccactgcattccagcctaggcgacagagcaagacttcgtctcagaaaaaaaaaaaaaagttaataatggcttcaagtatttcattttccccttattgtgaaataaactatatacattttaaatggaaattaaggtttagaccaaataaaatcattcagggaaattgcatttacttttaaaaatgtgttgttcaaaaatgtatatatagtacaaagtgaattgaccaaacagaataattcttaactcacaaaggagtttgagcgcacttcctacatgttgaatttaaatctgactaaaggattgtaaacagttgtaattatgggttgtagtaacagagcaacaaggggacaatcttctaaacttgcctttgcctaggagagctactgtatatttccacaagtgaatttaatcagcagtaggagtggtttactcgtcactgacatgtggcacaatctggacaaattacacaaactggctatctcagatgtgtaaaattaatgtacataaataaacgtaagtcacacaatgaatttcctttgtgtccactagatagagatggtcctaactacaaactagtagattatttgatgagcatcaagccctggcaagtgacaggagatgaattcctctccgttttttccttaaagcaaactgatgggaattgcacacaccccactggcaggaacaacagcaagccggctttgaagtctcttccctgcttcaacagctgaattggggagagcgcaagccctgcagccacacttcaaagcggcgctgactggctgtcctgcttctacccaacatccacctgagactcaacagaactgttttctttggaagaaaaatggaactactaataagctagtaattaacccttgtattctttttctggtttcatcttcctgttttaatgtgtaagatattcagcagtaagcactggtcagcctgccctggtgcacagcttgagtgtgttaaataactggctgtttagctgatgccagccagctgcgtgaaggggagaaggccgcctccaaggacacagatgtttgctgttgacctcacgctgtgtctggttgagttattcatgattcatcagaaaatgacatgcaaggtttatggtaaaactgctgtacaatcagaagtattttaagtatgcattagaagtaagataaaatagtaataaaaatagtttcagatgttaagatgatacaagaataaatttaacctagaaaataaagggagaaggaataaaag

SEQ ID NO: 182289 - DNA, 1466 bp, Homo sapiens
  Payload ID: 15898
  Gene Symbol: SMIM19
  Gene Name: small integral membrane protein 19
  Uniprot ID: Q96E16
  ENST ID: ENST00000417410
  CDS Start-End: 771-1094
gctcggtaaccgtttcccgcgcgcccggccccgactccggggtaaagagccccggagcggagcagcgctggccgcgtgccgcctccggagccggcagcgtgagtggccccgcgtccccgcttctcccggtccccggcggggccgcgtcacccggccccgccccgcgccgcccgccccgccccggacgcgggggtaaggggggtggccgcccgcctgccctcggtcccgtgcggtccccgaaactccgagcacccgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcaggtttgggagtcgtgtgtataacagccccgcgcctccacgcccaggcctgtgtggctttggacaagttatataaccaccgccgccaccccagtttcttctcctgtaaaatggagctttagtgccgcccagcagggttgttgggataattcagtgactctgtggactgcccagcacctgtgaattgctttcctggatgttgggtgaaggcctgtgagcttccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataa

SEQ ID NO: 182290 - DNA, 793 bp, Homo sapiens
  Payload ID: 15898
  Gene Symbol: SMIM19
  Gene Name: small integral membrane protein 19
  Uniprot ID: Q96E16
  ENST ID: ENST00000414154
  CDS Start-End: 98-421
gtaaccgtttcccgcgcgcccggccccgactccggggtaaagagccccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataa

SEQ ID NO: 182291 - DNA, 487 bp, Homo sapiens
  Payload ID: 15898
  Gene Symbol: SMIM19
  Gene Name: small integral membrane protein 19
  Uniprot ID: Q96E16
  ENST ID: ENST00000490331
  CDS Start-End: 46-369
cattaattaaaagaaaccctgctttcttttctctcttacagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttc

SEQ ID NO: 182292 - DNA, 233 bp, Homo sapiens
  Payload ID: 15898
  Gene Symbol: SMIM19
  Gene Name: small integral membrane protein 19
  ENST ID: ENST00000518574
  CDS Start-End: 125-233
gtccaggtccgctcggtaaccgtttcccgcgcgcccggccccgactccggggtaaagagccccggagcggagcagcgctggccgcgtgccgcctccggagccggcagcgaacaaaaggagaattatgaggatattcagtgtgccacctacagaggaaactttgtcagagcccaacttttatgacacgataagcaagattcgtttaagacaacaactggaaatgtattccattt

SEQ ID NO: 182293 - DNA, 878 bp, Homo sapiens
  Payload ID: 15898
  Gene Symbol: SMIM19
  Gene Name: small integral membrane protein 19
  ENST ID: ENST00000498447
  CDS Start-End: 53-313
cccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggatatttggcttttggaggattgaggagaatcacaatggaggaacttcactttgttgtgttaaatggatgtgttcagctacttttctcacagcctcatactttttagtgaaagaaagaatactttgagccaaggaagcagctctcaaagacaaaatagaaagtaaaatggtcttgtcatttaagtccttttaccacagcttctgatgaccaggatcatgagcatattacaactctatagacattaatacaaacatctcttctgcatggattttgtgtttaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaacc

SEQ ID NO: 182294 - DNA, 822 bp, Homo sapiens
  Payload ID: 15899
  Gene Symbol: SMIM2
  Gene Name: small integral membrane protein 2
  Uniprot ID: Q9BVW6
  ENST ID: ENST00000400419
  CDS Start-End: 190-447
gtgttcatgggcctcattaagctctgccttccttctgctttttggagcctggcctttggttggccttgaatgaagagtggggccccaaaagtaccactgtcagcactctccagcatcatctggctgtctggcaccatcaaagaattgcatttctgacccaagaagagcttatgggtggatgggggtgggatggaagctggggagaggattgatgccagccagctgcctcacagggtgctggaaacacgtggccatgccattagcatcctgttcggcttctggacgagtttcatctgtgacacctacatagtcctcgcttggatcagcaagataaaaggcagccctgatgttagtgcctcctctgatgagccatacgccagaatccagcagagcagaaggcaatgccacgcagaagaggaccaaagtcaggtgccagaagcaggctgacctggaaaggtggaggaaaagaaggcagaagggagagatgaagcccaagaacctgagtatttttctcaggcaagactcaggactgctctggacattcagaagctgagtgtgcaagtgtgctgtgtagttcaaggccaccaccactgaagaggccaaggacaccttagtaggaattctaacctggcttccagggagaggtgcttccaaattggccctgtaggcaaattcacttttttcaccctctaagcgagtaagtgcttgttcccaatttccatggtttagtcttcagtttcagtctttggtctcctctggtctatcagctcccatctctctcccagtctttttctttattctgtgacacctgttgaatgaggc

SEQ ID NO: 182295 - DNA, 255 bp, Homo sapiens
  Payload ID: 15899
  Gene Symbol: SMIM2
  Gene Name: small integral membrane protein 2
  Uniprot ID: Q9BVW6
  ENST ID: ENST00000617002
  CDS Start-End: 1-255
atggaagctggggagaggattgatgccagccagctgcctcacagggtgctggaaacacgtggccatgccattagcatcctgttcggcttctggacgagtttcatctgtgacacctacatagtcctcgcttggatcagcaagataaaaggcagccctgatgttagtgcctcctctgatgagccatacgccagaatccagcagagcagaaggcaatgccacgcagaagaggaccaaagtcaggtgccagaagcaggt

SEQ ID NO: 182296 - DNA, 935 bp, Homo sapiens
  Payload ID: 15900
  Gene Symbol: SMIM20
  Gene Name: small integral membrane protein 20
  Uniprot ID: Q8N5G0
  ENST ID: ENST00000506197
  CDS Start-End: 111-314
gcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccgtgttggaaaataaatatgaagcaagtcaaactagatgcatacacttgtgtagaaatcaataatcaattaatagaagtgaaaaaatagacattaaaatgatttatttcta

SEQ ID NO: 182297 - DNA, 774 bp, Homo sapiens
  Payload ID: 15900
  Gene Symbol: SMIM20
  Gene Name: small integral membrane protein 20
  ENST ID: ENST00000514384
  CDS Start-End: 6-152
acgccatgtcccggaacctgcgcaccgcgctcattttcggcggcttcatctccctgatcggcgccgccttctatcccatctacttccggcccctaatgagattggaggagtacaggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccgtgttggaaaataaatatgaagcaagtcaaactagatgcatacacttgtgtagaaatcaataatcaattaatagaagtgaaaaaatagacattaaaatgatttatttctac

SEQ ID NO: 182298 - DNA, 1190 bp, Homo sapiens
  Payload ID: 15900
  Gene Symbol: SMIM20
  Gene Name: small integral membrane protein 20
  Uniprot ID: Q8N5G0
  ENST ID: ENST00000614775
  CDS Start-End: 1-507
atggtaaaggaggtctggagggtgctgagggaggaaccgggccgaaggaaggaaagtagacagaacagggcccgcgggaatcgagtgcagcaaaacagctccaacctcaatccaacgccagcgcccggcccgcacagcacggaatcccggggaaggcggagggcggggtccgaggccccgcctaggcccggaagcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccgtgttggaaaataaatatgaagcaagtcaaactagatgcatacacttgtgtagaaatcaataatcaattaatagaagtgaaaaaatagacattaaaatgatttatttctactttgcagtggtgtctttttgtaaatcatcttttgtaaagcaattaaaattatagtgccgag

SEQ ID NO: 182299 - DNA, 1238 bp, Homo sapiens
  Payload ID: 15901
  Gene Symbol: SMIM21
  Gene Name: small integral membrane protein 21
  ENST ID: ENST00000382638
  CDS Start-End: 72-305
gcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacactttctacgtttgaagtcatccaggaacacagcagaagcagaataaatgacactacgtttctctctcatggccttcataccatggatttcccctgctcaagatgaaaagaaattaagaggaaatcagattgcttagagatagcagattattgctcactttttaaaaggagctccacagagagaatgaagaacgtgtaactttttgcaatgataatgtctgctttgttcttgaggggcactcttcctttttctgttcaggaatattccggaggagagctgcagatgccacccaaccctgcgaaatctgccctgcgtgtcgaaacagatccagcagtgcaaagaacttcttcattaggacatcaagcctgtagtcatattttcaattgctgctgtaactttttccttgcaagtgctttcacttatttcgggaccacctaaggctctgtgtggtatacagcaacacagtttgagatatttctgtgatgttctgtatatcatatagttgctaacaacctgtcaaagtcatcctgacaccaaactgagaagctgatggtttgggtaacatattagaggagatgaaaaaaccgacagtcctcattactgtaataaaaccagcagagacacactgagaatcaattactgattgtgacctaatgaactaaccctcagtcaagtagaaaactgcaccaagcctcttacattatcaaatgatttaggatggagcactgtctgaagacgggcaacaagtcgaggcagatgagttttcttatattgtggctgacttaattaccttgttcctgagtgcagagatcaaattgagcaacttaaggtgctaaagctctgtgccagctggaaatgaaaaggaaataattaacaccaacaagagctacgtctaaggttgtggcacctcctgacagaagcaaggagactcaaagttaaggcggctgcaaagtccttgacgaggtgagccctgctctatccgcctggctggattcgtccaggttgcctgtggcagctgtgcactgaagagtccggctg

SEQ ID NO: 182300 - DNA, 1834 bp, Homo sapiens
  Payload ID: 15901
  Gene Symbol: SMIM21
  Gene Name: small integral membrane protein 21
  Uniprot ID: Q3B7S5
  ENST ID: ENST00000579022
  CDS Start-End: 141-446
aatacccagatcttcaaggttggcaaagaagagaaaagctccttgggaacttagttaccaggtcttatagcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacatttgaaaatgaacaccatattcgtttcttcacattgttggttcttttccatgtgatggtgttgctgaggaatcatagcaggatacaaggggtttctgaagactggaaaagggccaacagcatatttcgaaactttctacgtttgaagtcatccaggaacacagcagaagcagaataaatgacactacgtttctctctcatggccttcataccatggatttcccctgctcaagatgaaaagaaattaagaggaaatcagattgcttagagatagcagattattgctcactttttaaaaggagctccacagagagaatgaagaacgtgtaactttttgcaatgataatgtctgctttgttcttgaggggcactcttcctttttctgttcaggaatattccggaggagagctgcagatgccacccaaccctgcgaaatctgccctgcgtgtcgaaacagatccagcagtgcaaagaacttcttcattaggacatcaagcctgtagtcatattttcaattgctgctgtaactttttccttgcaagtgctttcacttatttcgggaccacctaaggctctgtgtggtatacagcaacacagtttgagatatttctgtgatgttctgtatatcatatagttgctaacaacctgtcaaagtcatcctgacaccaaactgagaagctgatggtttgggtaacatattagaggagatgaaaaaaccgacagtcctcattactgtaataaaaccagcagagacacactgagaatcaattactgattgtgacctaatgaactaaccctcagtcaagtagaaaactgcaccaagcctcttacattatcaaatgatttaggatggagcactgtctgaagacgggcaacaagtcgaggcagatgagttttcttatattgtggctgacttaattaccttgttcctgagtgcagagatcaaattgagcaacttaaggtgctaaagctctgtgccagctggaaatgaaaaggaaataattaacaccaacaagagctacgtctaaggttgtggcacctcctgacagaagcaaggagactcaaagttaaggcggctgcaaagtccttgacgaggtgagccctgctctatccgcctggctggattcgtccaggttgcctgtggcagctgtgcactgaagagtccggctggggagccagggattcagaactcacagtgcagcctgacgaccaaagggcaaatccacctgaggacctgagtgcagatggctgggctccccggaacaaagtggaggaatgacagaggtgtaactcttacaccacagcctccatctgtgtgtcgcagagaaaaatactataatggagactattcttacacacatacacacacacacacacacacagagttcttgtcaccgatggaacagtctgtctttgtctttcatctcccacattcatgtccagatcccattgcgctgcatcacacgtgaacccagtgaggtcaacaatgaatggatggtgttcacaaagaaaccagcttatggaaggggacctgttacaattctttgaattaagttcttggaagcc

SEQ ID NO: 182301 - DNA, 2554 bp, Homo sapiens
  Payload ID: 15901
  Gene Symbol: SMIM21
  Gene Name: small integral membrane protein 21
  ENST ID: ENST00000584508
  CDS Start-End: 120-383
ggcaaagaagagaaaagctccttgggaacttagttaccaggtcttatagcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacatttgaaaatgaacaccatattcgtttcttcacattgttggttcttttccatgtgatggtgttgctgaggaatcatagcaggatacaaggggtttctgaagactggaaaagggccaacagcatatttcgaaagtaaaaaactccttctttctcccactgtaggctttttgtgttttcaacatacccagcctcactcggaaaaataaaaataaaaataaagcacccactcacatgagcagccaagtttcagataccagtgggcacaagctcttccaaatgtctcctgttctggagatgttcacagtcctcacatcaaaactgaaacaagcaaacaaaaaaataaaaagcttactaccaaataccctaggaataagacttaaactctatttggaaattgaatttcttccatagtcaatcaatatttaataaagagagaaaaggagctcattacaaagaccatcttgtttctccacaagtcatctatgtgagattccagaatttcagggcgataagttcttaattggaacattatatattctctttgcagccagtaagtacgcatcacttcacgagaaagcactgcggccaacatttctcctggtctgctctgggtttcagtgaagggcaggcctggaagcaccttgggaaatgaggtagagccaagctaaccctagagagccgttgagcttacggagggttgagtgattacgcaggcatagtcttgagttttattttcagtttgaatactgctaactagtctgtacagtcacaggcttactatagggagtttattctacatcagctatattctctcttccttagcagcacttaatgagttggctggaaagttgttcccagccaagccaatatcccatgagttataaatgacatttcatgctcatatgcagattttctgcaccgaagtgaattatttacaaggtaggccttatggattccaacagtcagctgcctgagatttacacctacccgttctctctactctcttgctgggagaatgtgacgtctcccactgccctttaacatctgaagatttagcgggagctgcccttcctgaggcaggtgctcccttgcttgagatggcaactggaaaggccatgcaccctggaagctggaaggtaaactgaggctctcccagaggtgcttctcctgcccggggaggatgctgtccgcatgcaaatgcacacgaggagcaccaggaagaatttaagttctggggaggccttcctgcccattaacagggattttattaccttgggttttagctacttagtttaataatttcttcctgaatgtgcgaaaatccaaattttctcctaaaggaagctctgtgttcagcagtgtgctctgtcctctgtggaacagaagaaccaacatgtcgtttctacctcccaggaactccaggggttgaaaagcctcccaacttacagcaaggatgatgaaaatataagtaagagttcggcaccagacaaatccaccaatggaacaaaaaaagcagcacagacaccagacaccaagttaagtacacaagggtctctaatctatgataaaatcagcatttaaaattagcaaaaagtatggttttttaaatatgttgaatgagaacaactgactatgcatttggaaaaagtaagatgaagatccctaccttatattatcaacaaaaatacatgtatgttgaatcaaagacctaaatgtaaaaataaaatccaaagaatactggaagaaaagatggaggaacatttctgtagccttgcagtgagagtaaacaaaaggaaagaagggacttaccaaattttataaactttttcccaataaaaaccagactaaacaaaattaaaacgtaagtgacaaacaagggagggaaaacatttacaactgactattaatatcccatattcagagaaatccaactcattggaagaaaatgacagacaataccctaaagggataaagaatacttataggcaaaaaagaagtacacacggcaaataaatctgtgaaaagatgctcaaccacggtattgattaaaggaataaggaagtgaataacaacaaaatagtttttgccaaatctgattgtcaacatgtcatatattgttaacattgattgctgtcgaggctgtgaaaaactaggcagcttcataattgttggcaggaacaaccaactgctacaaacattttgggggcaatttggaattatctaataaaatatatttgcataccctttggccatgccatttcacttttacggatctaacaaaaaataaaataaaaacattataaaggt

SEQ ID NO: 182302 - DNA, 394 bp, Homo sapiens
  Payload ID: 15902
  Gene Symbol: SMIM22
  Gene Name: small integral membrane protein 22
  Uniprot ID: K7EJ46
  ENST ID: ENST00000588606
  CDS Start-End: 93-344
ggagccggaagcaggaagcagcctgtgctccccaggacctgcctggttgggggaattggaggcttctaggaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccaga

SEQ ID NO: 182303 - DNA, 366 bp, Homo sapiens
  Payload ID: 15902
  Gene Symbol: SMIM22
  Gene Name: small integral membrane protein 22
  Uniprot ID: K7EJ46
  ENST ID: ENST00000586005
  CDS Start-End: 50-316
tggttgggggaattggaggcttctaggaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggaaagacccaagggagtggataacttggccctggaaccctgaccctgtgtctcctgcccggtggcagtaacaaagccttctgtctgcccaga

SEQ ID NO: 182304 - DNA, 525 bp, Homo sapiens
  Payload ID: 15902
  Gene Symbol: SMIM22
  Gene Name: small integral membrane protein 22
  Uniprot ID: K7EJ46
  ENST ID: ENST00000588500
  CDS Start-End: 33-440
ggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgg

SEQ ID NO: 182305 - DNA, 549 bp, Homo sapiens
  Payload ID: 15902
  Gene Symbol: SMIM22
  Gene Name: small integral membrane protein 22
  Uniprot ID: K7EJ46
  ENST ID: ENST00000586440
  CDS Start-End: 23-289
aggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtggg

SEQ ID NO: 182306 - DNA, 822 bp, Homo sapiens
  Payload ID: 15902
  Gene Symbol: SMIM22
  Gene Name: small integral membrane protein 22
  Uniprot ID: K7EJ46
  ENST ID: ENST00000589721
  CDS Start-End: 521-772
gcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccaga

SEQ ID NO: 182307 - DNA, 355 bp, Homo sapiens
  Payload ID: 15902
  Gene Symbol: SMIM22
  Gene Name: small integral membrane protein 22
  Uniprot ID: K7EJ46
  ENST ID: ENST00000591870
  CDS Start-End: 56-307
aggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgccca

SEQ ID NO: 182308 - DNA, 629 bp, Homo sapiens
  Payload ID: 15902
  Gene Symbol: SMIM22
  Gene Name: small integral membrane protein 22
  Uniprot ID: K7EJ46
  ENST ID: ENST00000589327
  CDS Start-End: 313-579
ttctaatccccacaatgaccccagcctaataatacaataatccccaagtagaaccaggggcccaaggccccctcgtcagctgggctcccacctccaagctgacgccctcaaccactctgctggggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggaaagacccaagggagtggataacttggccctggaaccctgaccctgtgtctcctgcccggtggcagtaacaaagccttctgtctgcccaga

SEQ ID NO: 182309 - DNA, 1047 bp, Homo sapiens
  Payload ID: 15902
  Gene Symbol: SMIM22
  Gene Name: small integral membrane protein 22
  Uniprot ID: K7EJ46
  ENST ID: ENST00000615889
  CDS Start-End: 521-787
gcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtggg

SEQ ID NO: 182310 - DNA, 928 bp, Homo sapiens
  Payload ID: 15902
  Gene Symbol: SMIM22
  Gene Name: small integral membrane protein 22
  Uniprot ID: K7EJ46
  ENST ID: ENST00000615471
  CDS Start-End: 521-928
gcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctga

SEQ ID NO: 182311 - DNA, 468 bp, Homo sapiens
  Payload ID: 15903
  Gene Symbol: SMIM23
  Gene Name: small integral membrane protein 23
  Uniprot ID: A6NLE4
  ENST ID: ENST00000330910
  CDS Start-End: 1-468
atggcaacccagcaagtggacagcagaaggcaggtggcagcagagcaggtggcagcccagctgcttgaacggagaaggggcagccactgtgatgacgagaagcagacgctgttggcattgctgatcttggtgctgtacttgagcacagagatatggggaagcagttgggaggtgtcagaaaggatcagagaatgtaactactaccagaatcttgcagttccccaggggcttgaatatcagaccaacgagccctcagaagaaccgataaagaccatcaggaactggctgaaggagaagttgcatgtcttctcggagaagttagaggaagaggtgcagcagctggagcagctagcgtgggacctggaactgtggctggatgctcttctgggagagccacaccaggaggagcactgctccacatataaaagtcacttgcacctggagcatgaggtcagcatcagagatcat

SEQ ID NO: 182312 - DNA, 366 bp, Homo sapiens
  Payload ID: 15903
  Gene Symbol: SMIM23
  Gene Name: small integral membrane protein 23
  ENST ID: ENST00000523047
  CDS Start-End: 1-366
agtggacagcagaaggcaggtggcagcagagcaggtggcagcccagctgcttgaacggagaaggggcagccactgtgatgacgagaagcagacgctgttggcattgctgatcttggtgctgtacttgagcacagagatatggggaagcagttgggaggtgtcagaaaggatcagagaatgtaactactaccagaatcttgcagttccccaggggcttgaatatcagaccaacgagccctcagaagaaccgataaagaccatcaggaactggctgaaggagaagttgcatgtcttctcggagaagttagaggaagaggtgcagcagctggagcagctagcgtgggacctggaactgtggctggatgc

SEQ ID NO: 182313 - DNA, 1329 bp, Homo sapiens
  Payload ID: 15904
  Gene Symbol: SMIM24
  Gene Name: small integral membrane protein 24
  Uniprot ID: O75264
  ENST ID: ENST00000215531
  CDS Start-End: 80-472
ggcagggcctcgcccacaccaaacctgtggacgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagccctttggaagggctcctgtcatctcttgggactcagtttacctctggggaaggaggctgcttttggggctgcgggcgatggctgggcggatgatatggaggctcagggtgcacaggtgcccagacgccctgagcagattaaacactcccccggcaatctggttttttgctgtcctgagccctggactttgagccctgagcgccgtctccaagcaaatctttgctccttcccccacctcactttgttttggggcacgtgacttttttcctgggagctgtatcttggagggtgggggtgccccagggccctgcaatatcttggaaagggactagcacttccttttcccagtttctgttctcctgcttcccctcaccttctccaggccctggaccttaccctgaacaatgaccatttctcttttatttga

SEQ ID NO: 182314 - DNA, 820 bp, Homo sapiens
  Payload ID: 15904
  Gene Symbol: SMIM24
  Gene Name: small integral membrane protein 24
  ENST ID: ENST00000587847
  CDS Start-End: 303-485
cccctacgccatccaggtctctgaagctccgtccctttccaataccccctctgtcggagcacccccagtgaccttctctctctccttgctagggtggtgggggaagggggtcttctgaccttttcttcctctgagtcgaacctccccaacttcctgcagccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgc

SEQ ID NO: 182315 - DNA, 660 bp, Homo sapiens
  Payload ID: 15904
  Gene Symbol: SMIM24
  Gene Name: small integral membrane protein 24
  ENST ID: ENST00000591708
  CDS Start-End: 42-224
atctctgcagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagccctttg

SEQ ID NO: 182316 - DNA, 2332 bp, Homo sapiens
  Payload ID: 15905
  Gene Symbol: SMIM3
  Gene Name: small integral membrane protein 3
  Uniprot ID: Q9BZL3
  ENST ID: ENST00000526627
  CDS Start-End: 1039-1221
acactactgggctccaagactgctcaaggtctcactgatagtcaaggcttgtgctcctttttttcagaagagtaagattaaagaaaaccactgtgaattaaaaagtgtgggtgccaacatgggacgggagtcccccctcactccatggatgacatagagggggcagaagattacagaattggcattgtcctgcgtggaagctgggccacccacagtggcgtgggaagcctctcagatgctggattctaatgggctcttgatcaccttggattgggctatttcattgttatcacaaaataaacaggatgctccaagtcatgttatggcagagaaccaaccagcttcacactggtcctctaaaccaatcctcacaacaggactgggagacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtg

SEQ ID NO: 182317 - DNA, 274 bp, Homo sapiens
  Payload ID: 15906
  Gene Symbol: SMIM4
  Gene Name: small integral membrane protein 4
  ENST ID: ENST00000307106
  CDS Start-End: 155-268
ggcactcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccagatgatgtctaccgtagaaaagcctcagaaagacagtatcagagaaggctggaagatgaatgagactgaacttcagcagtcaataaagtcaatatgaattttt

SEQ ID NO: 182318 - DNA, 1770 bp, Homo sapiens
  Payload ID: 15906
  Gene Symbol: SMIM4
  Gene Name: small integral membrane protein 4
  Uniprot ID: Q8WVI0
  ENST ID: ENST00000477703
  CDS Start-End: 152-364
actcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctatgatgtctaccgtagaaaagcctcagaaagacagtatcagagaaggctggaagatgaatgagactgaacttcagcagtcaataaagtcaatatgaatttttactattggtttcagtgccttttaaaatatacttttcagatctcttgttctgacacagcttgtcctttatcagctgcacaatattccaataactgtttttgcaaagaatttttatagttctgtctctgcttgagtacttcccaagtcactgctggacagcacttgtgggaaaattatttcctcctaaaacactcactcgatgaatctagtccatgaaatatttcttaaacaattcaaggatcaatcaggatgcttttcagtgaagcccgaattgttttcggcaatctttgtttttaggcaactaattataaccttatttacttttttgcagaattcaaattaaattatggacacattctctattgccagatcatttaaaccaggataattatgcaggttgtatttctgccagctactagactataaactttttgctagggtggtggaaattcttgattgactacgcatttctcatgctagtgttcttgtgaacagaaatatgctcctcccttgcttggctcccctaaactgcaagggctggatcttcatgaggactgtgggcaacaggtttcacactactctaggatgaagatgttgctgttcgattcagctgctagaaacagttgctccttccatgagaaagtgaacctacacagtataaagcatcccagacttgagctaaatcagaggctcagtctattgagtgatttggcaatctgacccagtgtaagtttggatcagcctggtagaaaaagcagatacctttccatgcttgcatagccacatctaacatcgtttcaagcaaaaaaaaatctacatactaaagactaagtttcagaatagtttctaactattgcatgagaataaagctgatgcttaaggccatagggtatcctcaagttaatgatctctgccacaaacatgtctcctaattttttctagatttttcttctaattttagtccacttatcttagaaccaattcagtaaagaaccattaactaactactcccatctccttaaagcactacctacactacagtgcagcaagcccagagtcacagctgggagatggcttgaatgtgaaaggccagtaatgacctctgccatcagggagaggacggtggttcatcgtattctcatgcccagttgtgtcatctaggattcctggtaaacctaacctgataaaccatttttagtgacttgactgctgtataaaaactatagtatgattctcaattatatggccatactccatgtttgccctaacccaccttgttttaggagtttagtatttgatacatatagaaaatacgtcataccttttacaaagaataatagtaaacactaataaaaccattggctaac

SEQ ID NO: 182319 - DNA, 522 bp, Homo sapiens
  Payload ID: 15906
  Gene Symbol: SMIM4
  Gene Name: small integral membrane protein 4
  ENST ID: ENST00000476842
  CDS Start-End: 152-331
actcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctattcaacctcatcttccctaattcaatgacactcacctgcccacacgaggacgcaccaggccatgggacttgatgaagacacagtcgccaaccttcagccacatgtcattgtaatggagctgctcaaagtagtggcaacctggttcaccattggacatttccacagggacatcttctttttcctgttgtaaagaaaactggctgaagaaaggtagttgat

SEQ ID NO: 182320 - DNA, 1546 bp, Homo sapiens
  Payload ID: 15907
  Gene Symbol: SMIM5
  Gene Name: small integral membrane protein 5
  Uniprot ID: Q71RC9
  ENST ID: ENST00000375215
  CDS Start-End: 806-1039
cacagccccagcagaaggccctcacctcacaaggaacatgaggcgccttgccgggcgcgcaggccactcccaggtcactcaggattccaagttctcccccaagacgccttcagatgctgagcggcacaagggcctccccagggactggttgcaaagcctcctgctcagcttgagagggccaccagctccccactgtttactgttgttcctgagagaggccagagggagggaccagccagggagtggccagagggacagaaggggtggccttcctgagggcagggtgggtgccccagacctgagagcgctgcaggactcccctccacaggctcaggtggagcctccccagggtcctcctggccaggaaggcagagagccgacttctttcttcagctcccaacccaggcccagcccacggcgtgggagtcggggagagggagaggaggaggaaggaggaggagagagggagcttgtcttgtccctgagcagcgctctcagggcagaggtgaggcaccgggacatgaagttggaggacaagttcccaagcagggcttcctcgggctccccctcgcgacggtaatttgacacttggatctccaggacgaccaacaacaaaaaagccaggcagagacagcagctggctgtcagcagaggagctgggctgaggcgcccaggggagcagcggcgcccacgaaggaagtacgaggacagcacgtggaggctccgcgctggggcactgctgctcagcccccaacacctgagctcccagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttacgtg

SEQ ID NO: 182321 - DNA, 4344 bp, Homo sapiens
  Payload ID: 15907
  Gene Symbol: SMIM5
  Gene Name: small integral membrane protein 5
  Uniprot ID: Q71RC9
  ENST ID: ENST00000537494
  CDS Start-End: 3608-3841
ggcactccttggcctggctttaaatagcccgctgggaagaccacctggggaccggctggaatgcgcctcctcctctttagagaacaggacccctcagctcccccacctgcgccatgaaggttcagtcgcgggtttacgctccaaatgacaagatatcaactgcaaaacaaagggggtcccggggttcctctccagctctctgggggcagaacagccacgtccaacggtcctacttctgctcactgtgtgacaggataccgtgagtacccctgggtcagaccctggggctgggtgaggctggccatgcctggctggcaaattcagcttccagtcagccccctagggaagccctgggcgcaaagctatgacactgtccacagccgcagcctgctgctgctgggaactgacacttttccccgctggaggccggggtccacccggcatgagtctgcagctctcccactttgcagcccctggaggaggctggccagagcttctcagcaacaaaccccacttttcctgcaccagtaaattcagcctcagtccaaccttcctcctccctgttctggtgagcacagccccaggtctctcgctcacaaggaaaagtgccccctgcaatctctccctgggtctctgggtgtggcacaagcgaaaaagctctccctgcccgctccctctttgaaggagtgtctctgctgggctacattaggccgtgtgggcacagtgccagtcaggctgaaaacgccagaccaagtgtagacagagagggaggggagaaaggcagcccagctcctgaaccacgcgcaaactgtcccgtaagggacactgtcggcattgtcgtccctctaagaatgagggaacctggaaagctggggcgtgaggatggcacggaggtcccggaaccaagaggggaccactgtccttgtgcaagcctgctccacctggccagagagaatgtcccattcagtctgaccagagggttcagtcctacactcaggctggctagactcacaagacctgtacctgtggtgacaaggactccaggtagtctcaaagagcctggtgtggccccggcctggtggtgatatgctgataaaagcagcttcagatccacaaatgtgggctggggctggccgagcacagccagctggcttccagggggctctcgggccctggctcctgtactgagcccactgcacgggcagtaccctcagcggggctgctcctggctatcttgctggtctaagctggagacaggcctccatggagagacagcgtggggcaccagtgggggtgctggctggggccctgtcctgctgtgtaacctcagagaagttgcttgctctctcgggtctcagcttccccacgtatagaaggaaggaggcgggagcggatgatctatagcattctaggaccctatgcctctcagtacatttgaaaactgagatcctcacctccacagaaacgcactcactccaggtgaggtgtgagaagctgggtggatctaactcagggaacccacggcttttgacaagaactcatctaattttccacggagccatcttctgcctgctaccctcatcatcacttaaaaaaacagctccccaggccgggcgcagtggctcacacctgtaatcccaacactttgggaggccgagggcggatcacctgatgtcaggagttcgagaccagtctggctaacatggtgaaatcctgtttctactaaaaatacaaaaattagccgggcatggtggcgcacactcgtgatcccagctactcgggaggctgaggcaggagaatcacttgaatctgggaggcagaggttgcagtgagctgagatcatgccattgcactctagcttgggcaacaagagagaaactccatctcaaagaaaaccaaaaccaacaacaaaaacatagctccccacctccagcttgcctaccttccttcagggcacacaccgcagacaccctaggacagacacccaaaaggtgttgggggtgctagtgacggtgcacgggggtgacagcccccaaagccagtgagacccgtcccgggggggcattctcgtgtgccgggcacccccctatggctgtctacaatgtgctgctagatggtcagtcctcccaatagcctcaaaacacgggcatctcattccatatcagagacatgaagcaacctgttcatgtcacaaaaggaagaagtggaggtggcattcaaggaggagcagctgaaaacactagagcaggcccctggcagagaaggaaatccagaaggtacatgccggctgccatcttgctcctgaagggctacgaggcagaagagggggcaaggtctaagtgaccacaagtgggactaactgggggccagcagggagtccgaccttctgcagtgggtgggctgcctcagcaggcggaggttcctcaccatcctgggtgctcatgcaaagaccacatggcctcaaggatggccgcaggccaattgcagggtggagggccccgttcgatgaccttcacggtggttctaaaccagctctgccaaggcagcggcaccgggagtgactggcctcactgacgtagccatctcagcgagaaccggctgagacctgggacaaggcaacgataattacagccaaaggtctggcaccagcccctggccacctgtccccaccaccacccctggattagagcaactgccttggtgaactggatcaggctgggttgggacaaggttgtctctggctcctctctaaagaggcaccagctccctcatgcccacaggagaggcagaaggggaaagccttctggagtggcaccttgggcctcttgggcaccctgagacaggaagaggctctcctggggcaggggtgggagtggagaggactttcctggtcaggctagagaaacagatgacgccagcaggggaggggctggcttgagcaacctgggcctcctgaccccctcccaacagacaggacagaaaccctggcaaaacctggagggacacggtgcggcctccccctctggcagaacaggcatgagtgtagaaactgggctggtgggagaggttggggggcctgggggacaggggggcagttttcacctctgactgaccctggccagaagccccatgaacctgctctcgggagaacctgctccttctgtccccacattgatggaaggcaagagtaccagcttggcatcctatcccagtctccccaccccgagggagctgtgccagtcccaagcacccaggcaaaacccagtagtggtacctcaagacaagggaatggaacagcgaagccagaaaccaccaccagccgccgccttggccggcagcccccgaagcaagcccttggtctcactgtcctcaccggcttcctccaccctgagctgtgtcagctgggtggggactgagggccaccactaggtggaagtcaccaggggtgcaatgtgtgagacctgacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgtta

SEQ ID NO: 182322 - DNA, 866 bp, Homo sapiens
  Payload ID: 15908
  Gene Symbol: SMIM6
  Gene Name: small integral membrane protein 6
  Uniprot ID: P0DI80
  ENST ID: ENST00000556126
  CDS Start-End: 268-456
agttaatcattcaccccacaacacaggaagtgagccctacgccagtcccagccccagggcttcctgagctcggggcaggtccgcagtccacacgtcacccagacagaggacagcccagcccagccacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccatcaggaaaaagtctagtaaaatactgtatctggcttagggttggtcagactagtaagatggggaggctggtctgagaccaattctggctccttgaccctattgtttttagggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctgct

SEQ ID NO: 182323 - DNA, 957 bp, Homo sapiens
  Payload ID: 15908
  Gene Symbol: SMIM6
  Gene Name: small integral membrane protein 6
  Uniprot ID: P0DI80
  ENST ID: ENST00000579469
  CDS Start-End: 357-545
ctgacttctctcaggagggactcatgaacacgtgccctgagcacccccaaaatgacatcacacaagggcagaaaggagctgaagggggaacgtgaaaggcagaaagggagccgtggttgccaggcaaccagccctagcccacctttgtttgtttggtgacagcaactaaggtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccatcaggaaaaagtctagtaaaatactgtatctggcttagggttggtcagactagtaagatggggaggctggtctgagaccaattctggctccttgaccctattgtttttagggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctgctaa

SEQ ID NO: 182324 - DNA, 850 bp, Homo sapiens
  Payload ID: 15909
  Gene Symbol: SMIM7
  Gene Name: small integral membrane protein 7
  ENST ID: ENST00000358726
  CDS Start-End: 33-344
ttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgagaaaactcaagcagattgcctttccatctagcactggggccataactctgatactactgttaacgaattgtgagatttgctgtaaatggatttaggaaaagacacgacgggagaatctggtgttcttggcctctgtgggtccatccctgtatgcttcccccagaaagagagaggacaaaaagttgtctgtcctgagtgattgagactccgaatgtggggttgctgtccagtctgcgtgccaccccagtggctgtttgcgaagatgcttccaggacataggagatctggggaggatggcatttcaccctcatcacaaggaccgtgatgtattcccaggaagactgttgccaaggtatcctacctggcagagaggatctgagagcatgtatgagacttgcctaggaacaaagaaggcttgtgaggagatcaaggaacttacatgaaattgtaggaacggccaggggcagtggctcaggcctgtaatcccagtactttgggaggccaaggtgggagaattgcttgagcccaggagttcaagaccagcctgggcagcatggtgaaaccctgtctttaccaaaaataaaaaaattagccgagtgta

SEQ ID NO: 182325 - DNA, 2776 bp, Homo sapiens
  Payload ID: 15909
  Gene Symbol: SMIM7
  Gene Name: small integral membrane protein 7
  Uniprot ID: Q9BQ49
  ENST ID: ENST00000487416
  CDS Start-End: 48-275
ccctggggcttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaggaccttttgtttatactttttttttttttttaaccaagaagtcaatttccaacctgagtccttttgaatttaccctgctggaaaaacctaggattcattttggaggccatgagaaagaaaagagtcagtggtagagtttcctttttggatttagctcaataaatgatggtcaagaattgggcaagtggggctgcgcgcagtggctcatacctgtaatcccagcactttgggaggccgaggtaggcggatcacttgaggtcaggagttcgaaactagcctggccaacatggtgaaatcgcatctctactaaaaatagaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctcaaaaaaaaaaaaaaaaaaagaattgagtaagtggaattttgactggagctgctcctgaaagtattgaaagagtcattgctaatggtgggctcttgctagaccagggtcaagtccacttttgctgcctctcaggttgtggaattctccttgatcacttctgcaattcatttccttgccaaatctcagccaagcatcaccccaaggtctgtaagtagcagagatcggagctgctgggtctggctttgctgaggccggtgtcgctgtcagaacaggcacgccaagatcttggctgggtccctcacaggccagatgaatggtgtgaagaaaccttcctgccttattcagactggcgcggaggtctcaatgaggcgaggcatttgtccattatggggatgaatcgtgctctcagaagagaatcctgtcattgaggttttgtttcaatagtcctctttttctccagagaactgttgtctcattgttaataatagcagcgtggctttttcagatgctggttggtggctgctgtacattttaaaaatggaatctcatggttgtgtctcttaaggaagcttttcaagaactttactggcaccagaggttatcagagtttgaagtttgggtgcctagtgtctcacagtgtttaagcactaatgttctgggtcagttaggtgtgagtacaaatcccatctcagctcattctgagagggaccttggctaattgctttctcctctccaagcctcagtttccacatctctaaaatcggcctgcaagtagtgtgtgcctaaggttgttgtaagtttcaatgaactcgaatgcggctgagtgcctgagagcacctgttgctgtgggtatcatcaccgtgtgtgttttctgtcttctcatccacttttctttgtgcagtctgcacacacaccattaaaggctgatgacagca

SEQ ID NO: 182326 - DNA, 1281 bp, Homo sapiens
  Payload ID: 15909
  Gene Symbol: SMIM7
  Gene Name: small integral membrane protein 7
  ENST ID: ENST00000465250
  CDS Start-End: 21-170
cggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaa

SEQ ID NO: 182327 - DNA, 1126 bp, Homo sapiens
  Payload ID: 15909
  Gene Symbol: SMIM7
  Gene Name: small integral membrane protein 7
  Uniprot ID: Q9BQ49
  ENST ID: ENST00000481671
  CDS Start-End: 21-248
cggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagggcattccaagcacaaaagaccttgttgtacctaaatactataaggg

SEQ ID NO: 182328 - DNA, 569 bp, Homo sapiens
  Payload ID: 15909
  Gene Symbol: SMIM7
  Gene Name: small integral membrane protein 7
  ENST ID: ENST00000461488
  CDS Start-End: 5-175
aacgatgatcggagacatcctgctgttcgggacgttgctgatgaatgccggggcggtgctgaactttaagctgaaaaagaaggacacgcagggctttggggaggagtccagggagcccagcacaggttggagtgcagtggtgcgatcatggctcactgcagactcgacctcctgagctaaagtgatccttccacctcagcccccttagtagctgggattacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttc

SEQ ID NO: 182329 - DNA, 602 bp, Homo sapiens
  Payload ID: 15909
  Gene Symbol: SMIM7
  Gene Name: small integral membrane protein 7
  ENST ID: ENST00000463051
  CDS Start-End: 5-148
aacgatgatcggagacatcctgctgttcgggacgttgctgatgaatgccggggcggtgctgaactttaagctgaaaaagaaggacacgcagggctttggggaggagtccagggagcccagcacagggcttgagagggagagtgattgactggaaaccctggaagaagggtctagaacccaggtctctggagtcttcacgtactaaattgccttccctcggaggggtttctgttccttggcattcaaggggaccagagtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttc

SEQ ID NO: 182330 - DNA, 2190 bp, Homo sapiens
  Payload ID: 15909
  Gene Symbol: SMIM7
  Gene Name: small integral membrane protein 7
  ENST ID: ENST00000487803
  CDS Start-End: 21-332
cggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgagaaaactcaagcagattgcctttccatctagcactggggccataactctgatactactgttaacgaattgtgagatttgctgtaaatggatttaggaaaagacacgacgggagaatctggtgttcttggcctctgtgggtccatccctgtatgcttcccccagaaagagagaggacaaaaagttgtctgtcctgagtgattgagactccgaatgtggggttgctgtccagtctgcgtgccaccccagtggctgtttgcgaagatgcttccaggacataggagatctggggaggatggcatttcaccctcatcacaaggaccgtgatgtattcccaggaagactgttgccaaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaggaccttttgtttatactttttttttttttttaaccaagaagtcaatttccaacctgagtccttttgaatttaccctgctggaaaaacctaggattcattttggaggccatgagaaagaaaagagtcagtggtagagtttcctttttggatttagctcaataaatgatggtcaagaattgggcaagtggggctgcgcgcagtggctcatacctgtaatcccagcactttgggaggccgaggtaggcggatcacttgaggtcaggagttcgaaactagcctggccaacatggtgaaatcgcatctctactaaaaatagaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctcaaaaaaaaaaaaaaaaaaa

SEQ ID NO: 182331 - DNA, 975 bp, Homo sapiens
  Payload ID: 15909
  Gene Symbol: SMIM7
  Gene Name: small integral membrane protein 7
  Uniprot ID: Q9BQ49
  ENST ID: ENST00000597781
  CDS Start-End: 21-248
cggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattataga

SEQ ID NO: 182332 - DNA, 1123 bp, Homo sapiens
  Payload ID: 15909
  Gene Symbol: SMIM7
  Gene Name: small integral membrane protein 7
  Uniprot ID: Q9BQ49
  ENST ID: ENST00000599310
  CDS Start-End: 333-560
gggaccccagaaagtgagtaggaattgctgcccagctaaccctacggcatcgagacctcacgcatgcgcggcacgcttcgaacgcgtgacccaatcccgcccccaggagaccccgctcctcccattctggctctcggggcctccccagcgaggtggggcgctcgcgctcccctaagggggtctggcctgcagagggcgggaccctcccagccttgaccttcgattggcccagccctcgccactgttgctttaggattggtcggcttgtgctcctctcccctccctccctggggcttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtgggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccg

SEQ ID NO: 182333 - DNA, 1757 bp, Homo sapiens
  Payload ID: 15909
  Gene Symbol: SMIM7
  Gene Name: small integral membrane protein 7
  Uniprot ID: Q9BQ49
  ENST ID: ENST00000593409
  CDS Start-End: 5-232
aacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaattgtggtggtacaggcctgtaatcccagttactagggaggctgaggcaggagaatcacttgaacctgggaagcagaggttgtgatgaaccgagattgcaccattgcactccagcctgggccacaagagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagactct

SEQ ID NO: 182334 - DNA, 1075 bp, Homo sapiens
  Payload ID: 15909
  Gene Symbol: SMIM7
  Gene Name: small integral membrane protein 7
  ENST ID: ENST00000597711
  CDS Start-End: 35-184
gcttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaa

SEQ ID NO: 182335 - DNA, 534 bp, Homo sapiens
  Payload ID: 15909
  Gene Symbol: SMIM7
  Gene Name: small integral membrane protein 7
  ENST ID: ENST00000602194
  CDS Start-End: 35-184
gcttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaa

SEQ ID NO: 182336 - DNA, 1076 bp, Homo sapiens
  Payload ID: 15909
  Gene Symbol: SMIM7
  Gene Name: small integral membrane protein 7
  ENST ID: ENST00000594662
  CDS Start-End: 77-268
ggctgggaagagagagccaggcaggacgcgggggcgcccctagtaactgtaattctccctctgcaggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagg

SEQ ID NO: 182337 - DNA, 1065 bp, Homo sapiens
  Payload ID: 15909
  Gene Symbol: SMIM7
  Gene Name: small integral membrane protein 7
  Uniprot ID: Q9BQ49
  ENST ID: ENST00000593404
  CDS Start-End: 35-262
gcttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaagga

SEQ ID NO: 182338 - DNA, 580 bp, Homo sapiens
  Payload ID: 15909
  Gene Symbol: SMIM7
  Gene Name: small integral membrane protein 7
  ENST ID: ENST00000600740
  CDS Start-End: 97-288
gggtaattagggggaccagaggctgggaagagagagccaggcaggacgcgggggcgcccctagtaactgtaattctccctctgcaggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttc

SEQ ID NO: 182339 - DNA, 603 bp, Homo sapiens
  Payload ID: 15909
  Gene Symbol: SMIM7
  Gene Name: small integral membrane protein 7
  ENST ID: ENST00000598278
  CDS Start-End: 29-178
ggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggag

SEQ ID NO: 182340 - DNA, 2171 bp, Homo sapiens
  Payload ID: 15909
  Gene Symbol: SMIM7
  Gene Name: small integral membrane protein 7
  ENST ID: ENST00000627144
  CDS Start-End: 21-332
cggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgagaaaactcaagcagattgcctttccatctagcactggggccataactctgatactactgttaacgaattgtgagatttgctgtaaatggatttaggaaaagacacgacgggagaatctggtgttcttggcctctgtgggtccatccctgtatgcttcccccagaaagagagaggacaaaaagttgtctgtcctgagtgattgagactccgaatgtggggttgctgtccagtctgcgtgccaccccagtggctgtttgcgaagatgcttccaggacataggagatctggggaggatggcatttcaccctcatcacaaggaccgtgatgtattcccaggaagactgttgccaaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaggaccttttgtttatactttttttttttttttaaccaagaagtcaatttccaacctgagtccttttgaatttaccctgctggaaaaacctaggattcattttggaggccatgagaaagaaaagagtcagtggtagagtttcctttttggatttagctcaataaatgatggtcaagaattgggcaagtggggctgcgcgcagtggctcatacctgtaatcccagcactttgggaggccgaggtaggcggatcacttgaggtcaggagttcgaaactagcctggccaacatggtgaaatcgcatctctactaaaaatagaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctc

SEQ ID NO: 182341 - DNA, 2405 bp, Homo sapiens
  Payload ID: 15910
  Gene Symbol: SMIM8
  Gene Name: small integral membrane protein 8
  Uniprot ID: Q96KF7
  ENST ID: ENST00000229570
  CDS Start-End: 64-357
ggggcgtctcgggcgaggagaggaggtgaccccgcgaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtgactacaagttgtaggacagtctttgtgtgtgctgagtgtcaacagctgcctgcctatgtgttgatgttttcatcctttctttgttgaatgagggtataaccatcaaaaataaaatacctttcaaata

SEQ ID NO: 182342 - DNA, 2437 bp, Homo sapiens
  Payload ID: 15910
  Gene Symbol: SMIM8
  Gene Name: small integral membrane protein 8
  Uniprot ID: Q96KF7
  ENST ID: ENST00000392863
  CDS Start-End: 90-383
ggggcggggcgtctcgggcgaggagaggaggtgaccccgcgaaaggaggatggacagaagaaaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtgactacaagttgtaggacagtctttgtgtgtgctgagtgtcaacagctgcctgcctatgtgttgatgttttcatcctttctttgttgaatgagggtataaccatcaaaaataaaatacctttcaaatagtccaa

SEQ ID NO: 182343 - DNA, 735 bp, Homo sapiens
  Payload ID: 15910
  Gene Symbol: SMIM8
  Gene Name: small integral membrane protein 8
  ENST ID: ENST00000608525
  CDS Start-End: 48-278
ggagaggaggtgaccccgcgaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctg

SEQ ID NO: 182344 - DNA, 1214 bp, Homo sapiens
  Payload ID: 15910
  Gene Symbol: SMIM8
  Gene Name: small integral membrane protein 8
  ENST ID: ENST00000448282
  CDS Start-End: 52-228
gcgaggagaggaggtgaccccgcgaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctgaactttccatcttacctactttttggactttaagaccataaaggacttcctctgctgaggacccaaactgaaccccaaggccagacagtattcttgatataccactgtatgctgcacagtatatttattgactgcagatggaagcacattgctaaggaatggaaagctgcaagatagaacatgcccttcacctgcgtggttgcatagaaaccagtcgtttgtccaaatcttaaagaactcaagtggaaagcatacttaaaaatgtaaaggttagaatcacaaactacagtttgaattgaaatgactgaaagattgtttcaagaatataagaattctatctaaaagaagtgaatgaaaggtatattctggctggagtgcaatggcgcgatctcagctcaccgcaacctccacctcccggcttcaggtgattctcctgcctcagcctcctgagtagctgggattacagcagtgtatgtatgaggaagtgcccacaggagtgtgcctccgggatgaagcaaagcaacagagatccaagcaggagaggctgcaacaggctggagatatgcagagtcttcatgggggagtgttcttccagctccctgccccacatccacccactgtcctcagacctcagctggggctgcaccccaaccctgagtgtgacagagagaagatgagtgttagagatcatgatcctgaagtgctgacgagaaattcaggaagcctgcaagcctagaggtcagctcagtggccaccttctgaagcccagggcaccattggaagctgcctagtttgaggcacggatggaagaggaaaacactgagaacaacatccctcttcctgaggaatgcatacaagggtgcttgggggtgggttggggatcccaaggcaggagagccaaagctggagtcagaggaagctcttcttctgaaacctgtaatttcaatgtcttttcctttcccttcaaaattgtaatttccttctgaaatcattctaaccctttagtaaagacattaatttaaagatg

SEQ ID NO: 182345 - DNA, 815 bp, Homo sapiens
  Payload ID: 15910
  Gene Symbol: SMIM8
  Gene Name: small integral membrane protein 8
  Uniprot ID: Q96KF7
  ENST ID: ENST00000608868
  CDS Start-End: 292-585
ggtaagcggcggcttcggtggtgttgagtggctgggcgccggcctggaggggccagggcggccgcaccatcacgctcccgtctctgcccttcccagctgccctgccggtctccctcccagggagggagcgtcctctcggatagcccaaatctttgcctctccgtggactccctgtacccgcaccccaagtcggtgaagctctctggccccacagagcccatttcccgtactcaccttgcgggctccagaggatggacagaagaaaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctct

SEQ ID NO: 182346 - DNA, 2111 bp, Homo sapiens
  Payload ID: 15910
  Gene Symbol: SMIM8
  Gene Name: small integral membrane protein 8
  Uniprot ID: Q96KF7
  ENST ID: ENST00000608353
  CDS Start-End: 333-626
gaagcggggcggggcgtctcgggcgaggagaggaggtgaccccgcgaaaggaggatggacagaagaaaaaggtaaagaacattttaccagagagaaacaaatgaagcaaataccccttagtttagaccttttttacaggcacctgtgaaatgttctactctcctctatttttttttttaagaaaagataaataacagtttcttaatcatgcatggaaaagggaacaagaagtgggtgatggaaaaatgaagaagaaataagagtggggcagattgcacagccaggggtgcctgattaattattttgcagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaa

SEQ ID NO: 182347 - DNA, 904 bp, Homo sapiens
  Payload ID: 15911
  Gene Symbol: SMIM9
  Gene Name: small integral membrane protein 9
  Uniprot ID: A6NGZ8
  ENST ID: ENST00000369529
  CDS Start-End: 198-497
aagactgaccagcttcttctgaagacttctgccctctaaagactaaggcctaattccactggtttctttgaattccgtggtcctaagtccattttcagacaaagtttctgtggaaagacctacggacaaagacatctctccttggcagagtgagctaggattaccagctcttcagccgcagctgaaggcgggagtccatggaaccccagaagctgctgataattggatttctgctatgctctctaacttgcctcttgttggagacagtagcttcctctcctttgcctttgtctgccttgggaatacaagaaaaaacaggatcgaaaccacgctcagggggtaatcacaggtcctggctgaacaacttcagggattacttatggcaacttatcaagagtgccttacctccagcagccattgttgcttttcttctcacctcagcactaatggggatcctctgctgcttcaccattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgccttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtga

SEQ ID NO: 182348 - DNA, 2512 bp, Homo sapiens
  Payload ID: 15912
  Gene Symbol: SMLR1
  Gene Name: small leucine-rich protein 1
  Uniprot ID: H3BR10
  ENST ID: ENST00000541421
  CDS Start-End: 9-332
actgagacatgctgagcaaaggccggagccccagaagaaaacaagtacagactcagaggaaagctgccctggtcctgagtgtgactcccatggtccccgtggggtctgtgtggttggcaatgagctctgtgctgtcagctttcatgagggagctccctggctggttcctgttctttggggtcttcctccccgtgactttgctgctgctcctcctcatcgcctacttcaggatcaaactgattgaggttaatgaagaactgtcccagaactgtgatcgccaacataatcccaaggatggctcttccctgtaccagagaatgaaatggacgtgaagttggggactttccaataactaaagcacaatgagtttctactggtcagcaagcaatggccaacagttcagctaataaagtaggttgataaactagaaccatagcaaaatagaaagaatactaagatactcattctgaaccatactgaaaagtggcagctattatctaaggggacttctcagagactcagtataacagcagctcttgaaaagtaccaagaatggatttcctgggtatatacactggacacattgtaactttttaacttttattgtgactgtgtctgctctaaacggcatatttaaaaaataaaattctgcagcatcttactacataatcccataggaacccctattattccgattttagaggtgaagaaaccttggtagagatccaatgaatagcaaaagatgaatgccttggagagagctcagtagattccatatgcaagaatatttccacgttcttcttgcagttcagcaactcttaagtgacacagttcaggtatcatttttggacctgactttgcttctctccttttcctgattgctttcacaaatcattattgtcacaaatatgcacaaaacaagtggagtatccccacactaggtatggatcacccacaaatgtagctttcagcatgatgcgacctggaaatgttggcaatttggtaatgggaaaaggaaagggcagaatgttcacataattcctgaggaggagaatacaagtctttgcctgtaataccaaaatacagggagctatatctaactatgcggataagtcaacatttcactacagttctttttcagtgggagccccaaagagacaacataggtaattgaaaagaaacttaattctaggggtagttaaacgagattgtggttactgttgtgctccccacattcttccagttaacataaatcaaagatgttcaatgcattctaagtgtaagactggttacattccaatctttgtgcaggacattaacaggctgagtgatccactttataaaacataatgaatggggtcacctgtaagaaatgcacctgtttcagtagtggcttacagtcatactaaaggttgtgtggatgacccaaagcaaaaatataccatcagtgctggatttttactgcttcttcccctcagccccaccctaaaattcttgatacccattccgtgagtagtttccatttgcacttcttgcataatataaaacttattgctagaataaagacactcacttctgcattttactgcacttgattacaatgaaaatgtctgccggggttttcagactgaactaattcagagtaacagtgctcttgccatatggaaggaataacaatattctttcagttttgggagagatctctttttagcccctgggggaaatcagcttatgtaaaaatgctttctttaacagaaagtgtgaaaggacagatcgtattcctatctcaggcagctgccagccacatttgtggctcagctatcaaggtttgctccatcttcctccaataatgggcacttcagaaggccagttccagctctggtgggtgctggtccaccatctcagctattgtgataacacatgagctctatatagacatgttttcagcaccaagcactaccaagtactttagaacaaggcctgtttcttttctgccatccaatgagagcagagaatctccaatgaaactgactagatttatgaatgttttttatatgtagagaggggcagaaacatgttcattttcccatgaaggaacaagtcccaagggtttatcatctgcctgaaggcactgctaacgaatttgtcaaatcctttatccagcacagctttaccaagcagctgcacagtcaggcctttgcacttctcattctcataggtccagtttaagatctcattcagtcctgaactgcttcggtcctttgcattcctgctgtcttggcctccacctagaccaagtcggcagtctccctacattaccctacattcagctgcatcctatgctccaaggcctttcaccaggggccagaaatgctcccacaaccctcaatggtctcactacaacagttccgaatcttattccaaatgctatagtatctgaaacggttcaccaatagggataatgtttctccaactggagaccttcaataaaacacttcaataggtgctttaa

SEQ ID NO: 182349 - DNA, 1035 bp, Homo sapiens
  Payload ID: 15913
  Gene Symbol: SMKR1
  Gene Name: small lysine-rich protein 1
  Uniprot ID: H3BMG3
  ENST ID: ENST00000462322
  CDS Start-End: 347-544
cgaggccctgccccacgcccggtgattgtgcgcgcggccccgcccccgaggcgcacgccggcccagcgcccacagctgcggcggcctaggtgccgcgtggggcaagcaggtgcctcgcgtccaggcggctccgcggctggctgcctcccgagccggccgcgctcctcccagcgaggcgtggcggggaggcgtagtgaggctgggcccgtggcggttccctgaggagggccgagaaggggccgggggtgctaggggaacgggcgctgggggcagcggccccggtggatgctaagggcttcgggatcgggagagtccaccacgcctgcctgctcggctgagaatcgccatgccagctaaagggaaaaaaggaaaaggccagggcaagtctcatgggaagaaacagaagaaaccagaagtggacattctcagccccgcggccatgctgaacctctactacatcgcccacaacgtcgctgactgcctgcatctgcgaggcttccattggccgggtgctcccaaaggaaagaaagggagaagcaagtgacagcatttcacaacacatctctgttacagacaacaggacctggggaagagaagtcaggataacacaactgttgccagcaacatagactttactccagacgacttgagatgcaaattaagtgtgcttttctgtgatggtggaagatcaggaaatgcaccttacttcctctgttatgccagatatggttagccactttggttttttaggagctataggatgggaaaagcctgagtaattcctacacagtgtgctgaaattaatagaactttcagaaattattataattctgggtcaggattaaactttgctctcagaaggcagttctagttgcattaattgttttcttttgccaaagagcgtttgtcatttagagaagacacggcaagaaacactgggtttccttaggaacattcctctcttgggcaccatttccttttttttttttaatggaaaataataaatactttgtttctataattttcttctcagca

SEQ ID NO: 182350 - DNA, 938 bp, Homo sapiens
  Payload ID: 15914
  Gene Symbol: SMPX
  Gene Name: small muscle protein, X-linked
  Uniprot ID: Q9UHP9
  ENST ID: ENST00000379494
  CDS Start-End: 235-501
aacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtgaa

SEQ ID NO: 182351 - DNA, 7165 bp, Homo sapiens
  Payload ID: 15915
  Gene Symbol: SNRNP200
  Gene Name: small nuclear ribonucleoprotein 200kDa (U5)
  Uniprot ID: O75643
  ENST ID: ENST00000323853
  CDS Start-End: 79-6489
cgggagcagagatctgcggccgtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccaagcgaagaaagcgtgatgaggaccggcatgacatcaacaagatgaagggttatactctgctgtcggagggcattgatgagatggtgggcatcatctacaagcccaaaactaaagagactcgggagacctatgaggtgctactcagcttcatccaggctgctcttggggaccagccacgtgatatcctttgtggggcagctgatgaagttctagctgttctaaagaatgaaaagctgcgggacaaggaaaggcgaaaggagattgacctgctgctgggtcaaacagatgataccagataccatgtgctagtgaacctgggcaaaaagatcacagactatggtggagataaggaaatccaaaatatggatgacaacattgatgagacatacggtgtgaatgtgcagtttgagtctgatgaggaggaaggtgatgaagacgtatacggggaggttcgagaagaggcatctgatgatgacatggaaggggacgaggctgtcgtgcgctgcaccctctcggctaatctcgtagcctcaggtgaactgatgagttccaagaagaaggatttgcaccctcgggatattgatgcattttggctgcagcggcagctcagtcgtttctatgatgatgccatcgtgtcgcagaagaaggcagatgaagtattggagattttgaagacggccagtgatgatcgggaatgtgaaaatcagctggttctgctgcttggtttcaacacctttgatttcattaaagtgttgcggcagcacaggatgatgattttatactgtaccttgctggccagtgcacaaagtgaagctgaaaaggaaaggattatgggaaagatggaagctgacccagagctatccaagttcctctaccagcttcatgaaaccgagaaggaggatctgatccgagaggaaaggtcccggagagagcgagtgcgtcagtctcgaatggacacagatctggaaaccatggatctcgaccagggtggagaggcactggctccacggcaggttctggacttggaggacctggtttttacccaagggagccactttatggccaataaacgctgtcagcttcctgatggatccttccgtcgccagcgtaagggctatgaagaggtgcatgtgcctgctctgaagcccaagccctttggctcagaagaacaactgcttccagtggaaaagctgccaaagtatgcccaggctgggtttgagggcttcaaaacactgaatcggatccagagtaagctctaccgtgctgcccttgagacggatgagaatctgctgctgtgtgctcctactggtgctgggaagaccaacgtggccctgatgtgcatgctccgagagattgggaaacacataaacatggacggcaccatcaatgtggatgacttcaagattatctacattgcccccatgcgctccttggtgcaggagatggtgggcagctttggaaagcgcctggccacttatggcatcactgttgctgaactgactggggaccaccagctgtgcaaagaagagatcagtgccactcagatcatcgtctgcacccccgagaagtgggacatcatcacccgcaagggtggtgagcgcacctacacccagctggtgcggctcatcattctggatgagattcatcttctccacgatgacagaggtcctgtcttagaagctttagtggccagggccatccgaaacattgagatgacccaagaggatgtccgactcattggtctcagtgccaccctacccaactatgaagatgtagccacctttctacgtgttgaccctgccaagggtctcttttactttgacaacagcttccgtccagtgcctctggaacagacatatgtgggtatcacagagaaaaaagctatcaagcgtttccagatcatgaatgaaatcgtctatgaaaaaatcatggaacatgctggaaaaaatcaggtgctggtgtttgtccactcccggaaggagactggaaagacagccagggccatccgggacatgtgcctagaaaaggacactctgggtctgtttctgagggagggctcagcctccacagaagtcctgcgaacagaagctgagcagtgcaagaacctagagctgaaggatcttctgccttatggctttgctattcatcacgcaggcatgaccagggttgaccgaacactcgtggaggatctttttgctgataaacatattcaggttttagtttccacagcaactctagcttggggtgtgaatctccctgcacatacagtcatcatcaaaggcacccaggtgtacagtccagagaaggggcgttggacagaactgggagcactggacattctgcagatgctgggacgtgccggaagaccccagtatgacaccaagggtgaaggcatactcatcacatctcatggggagctacagtactacctgtccctcctcaatcaacaacttcctattgaaagccagatggtttcaaagcttcctgacatgctcaatgcagaaatcgtgctaggaaatgtccagaatgccaaggatgcggtgaactggctgggctatgcctacctctatatccgaatgctgcgatccccaaccctctatggcatctctcatgatgacctcaagggagatcccctgctggaccagcgccgactagatctggttcatacagctgccctgatgctggacaagaacaatctggtcaagtacgacaagaagacgggcaacttccaggtgacagaactgggccgtatagccagccactactacatcaccaatgatacagtgcagacttacaaccagctgctgaagcccaccctgagtgagattgagcttttcagggtcttctcattgtcctctgagttcaagaacatcacagtgagagaggaggagaagctggagctgcagaagttgctggagagggtgcctatccctgtaaaggagagcattgaggaacccagtgctaagatcaacgttcttctgcaagccttcatctcacagctgaaattggagggctttgcactgatggctgacatggtgtatgtcacacagtcggctggccggttgatgcgagcgatatttgaaattgtcctgaaccgaggttgggcacagcttacagacaagaccctgaacctctgcaagatgatcgacaaacgcatgtggcagtccatgtgtcctctgcgccagttccggaaactccctgaggaagtagtgaagaagattgagaagaagaatttcccctttgagcgtctgtacgacctgaatcataatgagattggggagcttatccgcatgccaaagatggggaagaccatccacaaatatgtccatctgtttcccaagttggagttgtcagtgcacctgcagcctatcacacgctccaccctgaaggtggagctgaccatcacgccagacttccagtgggatgaaaaggtgcatggttcatccgaggctttttggattctggtggaggatgtggacagcgaggtgattctgcaccatgagtattttctcctcaaggccaagtacgcccaggacgagcacctcattacattcttcgtgcctgtctttgaaccgctgccccctcagtacttcatccgagtggtgtctgaccgctggctctcttgtgagacccagctgcctgtctccttccggcacctgatcttgccggagaagtacccccctccaaccgaacttttggacctgcagcccttgcccgtgtctgctctgagaaacagtgcctttgagagtctttaccaagataaatttcctttcttcaatcccatccagacccaggtgtttaacactgtatacaacagtgacgacaacgtgtttgtgggggcccccacgggcagcgggaagactatttgtgcagagtttgccatcctgcgaatgctgctgcagagctcggaggggcgctgtgtgtacatcacccccatggaggccctggcagagcaggtatacatggactggtacgagaagttccaggacaggctcaacaagaaggtggtactcctgacaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatgggcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcgactgtggcctggcctcagtggtacccacacatcagcactaccacaagaaccaacactgagcctcggaagctagatcacaggttaggggtttctctagatgggggttctgaaatttgcagtgtctgctcctgggaggcagcaccagaaagggcactgaaatgtactagctggatgtgacccagtcttaataaacaggttttctaatccaga

SEQ ID NO: 182352 - DNA, 2637 bp, Homo sapiens
  Payload ID: 15915
  Gene Symbol: SNRNP200
  Gene Name: small nuclear ribonucleoprotein 200kDa (U5)
  ENST ID: ENST00000429650
  CDS Start-End: 389-2176
ttgatacttacactgcttctttctgttggtttccagtgtttaacactgtatacaacagtgacgacaacgtgtttgtgggggcccccacgggcagcgggaagactatttgtgcagagtttgccatcctgcgaatgctgctgcagagctcggaggggcgctgtgtgtacatcacccccatggaggccctggcagagcaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatgggcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccatctatgacgtgcttcagatggtgggccacgccaaccgccctttgcaggacgatgaggggcgctgtgtcatcatgtgtcagggctccaagaaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattgagctcttcagcatgtccctcaatgccaagaccaaggtgcgagggcttatcgagatcatctccaatgcagcagagtatgagaacattcccatccggcaccatgaagacaatctcctgaggcagttggctcagaaggtcccccacaagctgaataaccctaagttcaatgatccgcacgtcaagaccaacctgctcctgcaggctcacttgtctcgcatgcagctgagtgctgagttgcagtcagatacggaggaaatccttagtaaggcaatccggctcatccaggcctgcgtggatgtcctttccagcaatgggtggctcagccctgctctggcagctatggaactggcccagatggtcacccaagccatgtggtccaaggactcatacctgaagcagctgccacacttcacctctgagcatatcaaacgttgcacagacaagggagtggagagtgttttcgacatcatggagatggaggatgaagaacggaacgcgttgcttcagctgactgacagccagattgcagatgtggctcgcttttgtaaccgctaccctaatatcgaactatcttatgaggtggtagataaggacagcatccgcagtggcgggccagttgtggtgctggtgcagctggagcgagaggaggaagtcacaggccctgtcattgcgcctctcttcccgcagtttagggccgggcgcagtggctcacgcctgtaatcccagcactttgggaggccaaggcgggcggatcacgaggtcaggagttcgagaccagcctggccaacatagtgaaaccccgtctctactaaaaatacaaaaattagctgtgcgtggtggtgggcacctgtagtcccagctactcaggaggttgagtcaggagaatggtgtgaacccaggaggcggaggctgcagcgagccgagattgccccactgcacaccagcccagaaacgtgaagagggctggtgggtggtgattggagatgccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcag

SEQ ID NO: 182353 - DNA, 1905 bp, Homo sapiens
  Payload ID: 15916
  Gene Symbol: SNRNP25
  Gene Name: small nuclear ribonucleoprotein 25kDa (U11/U12)
  ENST ID: ENST00000293861
  CDS Start-End: 1008-1379
gcacgatgagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcgcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgca

SEQ ID NO: 182354 - DNA, 1085 bp, Homo sapiens
  Payload ID: 15916
  Gene Symbol: SNRNP25
  Gene Name: small nuclear ribonucleoprotein 25kDa (U11/U12)
  Uniprot ID: Q9BV90
  ENST ID: ENST00000383018
  CDS Start-End: 162-560
cagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgc

SEQ ID NO: 182355 - DNA, 831 bp, Homo sapiens
  Payload ID: 15916
  Gene Symbol: SNRNP25
  Gene Name: small nuclear ribonucleoprotein 25kDa (U11/U12)
  ENST ID: ENST00000397876
  CDS Start-End: 131-409
ccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctgcaaggtttgtttggccaagccgccccagacagccctctgagaacagagcctccttgtagctgcctcagacccaatctgcacattgtacagaacagcccaggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctag

SEQ ID NO: 182356 - DNA, 408 bp, Homo sapiens
  Payload ID: 15916
  Gene Symbol: SNRNP25
  Gene Name: small nuclear ribonucleoprotein 25kDa (U11/U12)
  ENST ID: ENST00000417493
  CDS Start-End: 119-408
ggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaaagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgaga

SEQ ID NO: 182357 - DNA, 1802 bp, Homo sapiens
  Payload ID: 15917
  Gene Symbol: SNRNP27
  Gene Name: small nuclear ribonucleoprotein 27kDa (U4/U6.U5)
  Uniprot ID: Q8WVK2
  ENST ID: ENST00000244227
  CDS Start-End: 426-893
gggcctttagttttccttccaagagcccataggaggttttgggtgccttctcaatgctggcatgagaaaatataaagcagatggacagtgaactttggtatattcactccttatgaatgttatgtggaaaagtggaagaacataagctgtttgtctatgctatgtttacaattggtttgctctattttgtgcatgtggacaaaaatgggggaaaaatgaaagctgtgttaggataatgggtatacggctgaattttccaggaatttctataataacaccaaatcgcatgttttaatgcccaccgtgaacaaagaagaccggaaccctcgcaactcgttttgacgttttctggtcggcggtaaaagctcggttcccggccctcccggaagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactacta

SEQ ID NO: 182358 - DNA, 1339 bp, Homo sapiens
  Payload ID: 15917
  Gene Symbol: SNRNP27
  Gene Name: small nuclear ribonucleoprotein 27kDa (U4/U6.U5)
  ENST ID: ENST00000409116
  CDS Start-End: 27-503
gttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaagcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactactat

SEQ ID NO: 182359 - DNA, 766 bp, Homo sapiens
  Payload ID: 15917
  Gene Symbol: SNRNP27
  Gene Name: small nuclear ribonucleoprotein 27kDa (U4/U6.U5)
  Uniprot ID: Q8WVK2
  ENST ID: ENST00000450162
  CDS Start-End: 22-489
ttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctaccctttta

SEQ ID NO: 182360 - DNA, 604 bp, Homo sapiens
  Payload ID: 15917
  Gene Symbol: SNRNP27
  Gene Name: small nuclear ribonucleoprotein 27kDa (U4/U6.U5)
  ENST ID: ENST00000487029
  CDS Start-End: 1-55
gcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagaaatatcatttgtggcaggcgtcaaccccattttatttgtccttattcctgtggaagcagtatatgttttcttcctgaatgctcattaggacttcttaaaaaacatgaaagtaatttggaaggtccgtacttagacgtggcattgctgagtgagattaaaagggccatgtatacatgttttaagacatttggtatctctggctaaaaggtaacagccaactctatccagtaaagtatgagcattcttgtttcagatacatgtacaaatattaagtgtaaaatttgttttaaagtttcctacctgatgggtaaaataatggtactatttggttttgtatttttgtttcatttctagggaggatgaatattttttaaatgtattagccatatttcttttgtaacatgctaattttaaatcttggatctattaa

SEQ ID NO: 182361 - DNA, 942 bp, Homo sapiens
  Payload ID: 15918
  Gene Symbol: SNRNP35
  Gene Name: small nuclear ribonucleoprotein 35kDa (U11/U12)
  Uniprot ID: Q16560
  ENST ID: ENST00000350887
  CDS Start-End: 93-833
tgctgggattacaggcgtgagccaccgcgtctggcctcagccaaggtttttaagtaacatatttcagcattggctctacagcgttgcagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatca

SEQ ID NO: 182362 - DNA, 1140 bp, Homo sapiens
  Payload ID: 15918
  Gene Symbol: SNRNP35
  Gene Name: small nuclear ribonucleoprotein 35kDa (U11/U12)
  Uniprot ID: Q16560
  ENST ID: ENST00000412157
  CDS Start-End: 367-1122
cacgcctgtaatcccagcactttgggaggctgaggcaggcgggtcatctgacatcaggagtttgagaccagcttggccaacatggtgaaatcctgtctgtactaaaaatgcaaaaattagctgggcgtggtggtgtgtgtctgtaatcccagctactcgggaggctgaggcaggagaatcacttgaacctgggaggcagaggttgcagtgagccgagattggccattgcactccagcctgggtgacagagtgagactttgtctcgagtaaaaaaagagaatgtaaaaatcgaaagagattgttgtaggaaatctcaacctaatgctgccggggaggaagtgcacctagaaagattaatgagaaacaatgaaaccagctaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaacc

SEQ ID NO: 182363 - DNA, 1975 bp, Homo sapiens
  Payload ID: 15918
  Gene Symbol: SNRNP35
  Gene Name: small nuclear ribonucleoprotein 35kDa (U11/U12)
  Uniprot ID: Q16560
  ENST ID: ENST00000526639
  CDS Start-End: 580-1320
agcactttgggaggccgaggcgggcggatcacttgaggtcagaagttcgagaccagcctggccaacatggcaaaaccctgtctctactaaaaatacaaaaaatagccgggcgtggtggcgggcgccagtaatcccagctacgcgggaggctgaggcaggaaaatcacttgaacccgggaggcggaggttgcagtgagccgagttcgcaccactgcactccagcctgggcgacagagggagtctccgtctcaagaaaaaataataaataagaataaataaataataaagtaaaatgtcccaggtaactgcatattcgatagtctttctttcaacttagttgttgaattagcaatttttctcttaaaaaaatttttttttagcttattgtcttcggagatgataacaccctcgttgcgtgggagtaaaattttaaaggtaaaacaaacaggaaacgagcgtcggcggcgaatctgctgctaccaatgtaaaggtcaggccgaggccggcgcggagaatctgctgtcgcctgcagctgctcgcctgtctccgtcggaagggagcccaagctttgcagagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcatggggtttggaatagttttctttccaatctggaacttcggttcaagctgataggaatttatcatcttcctcacatagttctaaggacatgttatttaacaggatcaagaagcaattttgtagttactggcatctgtacagaagggcattttcttttcttttcttttttttttttttgagacagagtctcactctgttgccagggctggagtgcagtggtaaaatcttggctcactgtaacctctgcctcctgggttcaagtgattctcctgcctcagcctccccagtagttgggattacaggcatgtgccaccatgcccgactaatttttgtatttttagtggagatggggtttcaccatgttggtcaggctgttttcgaactcctgacctcagatgatccacctgccttggcctcccaaagtgctgggattacaggtgtgagccactactcctggcctggtctccaactcttgacctcaaatgagccacctgccttagcctcccaaagtgctgggattacaggcataagccactgcgcccagcca

SEQ ID NO: 182364 - DNA, 1597 bp, Homo sapiens
  Payload ID: 15919
  Gene Symbol: SNRNP40
  Gene Name: small nuclear ribonucleoprotein 40kDa (U5)
  Uniprot ID: Q96DI7
  ENST ID: ENST00000263694
  CDS Start-End: 20-1093
gaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggattttttttttttttttgtaactggcttgtatgatattttctttctgtatttctctatatcattttgtattaaaagccaaatagatgcctttttacaagagccatgtggattggatttattgctgtcttttttttgaggcttgattgctataaatcagaatagagcatgatgtggccacagaatacaattcatttaaacttccaa

SEQ ID NO: 182365 - DNA, 1087 bp, Homo sapiens
  Payload ID: 15919
  Gene Symbol: SNRNP40
  Gene Name: small nuclear ribonucleoprotein 40kDa (U5)
  ENST ID: ENST00000373720
  CDS Start-End: 342-725
agggaaattaggaaagggcgatgtaagtttggcttttataagttcattgtcacagtagttcctggtatttagtttgtcacattgaagctttgctggatgtgactaagctggcagagaaatcttgcaaaatatctttttgaaattagtatcacacccaactgcattctgttgcaaattaccaacattgtgtgtgacatttttccttcctgccccctcagctagccccagttattgggatttagatgtgttttcctgcttgaaaaagaaaagagccttaacaggtagcagtatgtcaagttggactttgcccaccgaggaaacagcatctgccattgattgacatgatactaatttcagctgggtgcccaggaggcctctggccgatagttgttttggttggtttgtttatttggatttgttttgcagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggattttttttttttttttgtaactggcttgtatgatattttctttctgtatttctctatatcat

SEQ ID NO: 182366 - DNA, 4173 bp, Homo sapiens
  Payload ID: 15920
  Gene Symbol: SNRNP48
  Gene Name: small nuclear ribonucleoprotein 48kDa (U11/U12)
  Uniprot ID: Q6IEG0
  ENST ID: ENST00000342415
  CDS Start-End: 60-1079
gaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaagaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttgcttgagtgtgtttacaagtcaatttccttttatgtagcttgctttttcatttgctataattgatcctgcaggtgtgtgaattattaaactaacgctcttttaaaccaca

SEQ ID NO: 182367 - DNA, 781 bp, Homo sapiens
  Payload ID: 15920
  Gene Symbol: SNRNP48
  Gene Name: small nuclear ribonucleoprotein 48kDa (U11/U12)
  ENST ID: ENST00000634363
  CDS Start-End: 33-482
ggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaataattggggaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtg

SEQ ID NO: 182368 - DNA, 1603 bp, Homo sapiens
  Payload ID: 15921
  Gene Symbol: SNRNP70
  Gene Name: small nuclear ribonucleoprotein 70kDa (U1)
  Uniprot ID: P08621
  ENST ID: ENST00000221448
  CDS Start-End: 197-1483
agtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgtt

SEQ ID NO: 182369 - DNA, 3144 bp, Homo sapiens
  Payload ID: 15921
  Gene Symbol: SNRNP70
  Gene Name: small nuclear ribonucleoprotein 70kDa (U1)
  Uniprot ID: P08621
  ENST ID: ENST00000401730
  CDS Start-End: 197-697
agtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctcccaccccagtcgcccccgtagcctccccgcacccatggccctttccttgtttgggtgccctttgtccctcctgccccgatccgtatgctctctgagaatcttgctgatcccaggaggggaaggatgaacctggtgggaaaggcggcggcctctccgcttgggttccacccagcctctgatgacccggcttcgtgatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcgccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttg

SEQ ID NO: 182370 - DNA, 377 bp, Homo sapiens
  Payload ID: 15921
  Gene Symbol: SNRNP70
  Gene Name: small nuclear ribonucleoprotein 70kDa (U1)
  ENST ID: ENST00000601411
  CDS Start-End: 278-377
gccacccctggagaaactgccacatgaaaaacaccacaatcaaccttattgtggcattgcgccgtacattcgagagtttgagggtcatctcttaggtgcatcagagcacacctgagaaaagctggcacacagtcggaagttacaagaagaacgttctagcattgggtaggtaagggcagctggaggcgagggagttgcagagcagaatttcgtagataacagaaaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcaggggg

SEQ ID NO: 182371 - DNA, 1757 bp, Homo sapiens
  Payload ID: 15921
  Gene Symbol: SNRNP70
  Gene Name: small nuclear ribonucleoprotein 70kDa (U1)
  Uniprot ID: P08621
  ENST ID: ENST00000601065
  CDS Start-End: 229-729
gggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatgccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcc

SEQ ID NO: 182372 - DNA, 547 bp, Homo sapiens
  Payload ID: 15921
  Gene Symbol: SNRNP70
  Gene Name: small nuclear ribonucleoprotein 70kDa (U1)
  ENST ID: ENST00000598984
  CDS Start-End: 266-547
tttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccacc

SEQ ID NO: 182373 - DNA, 1673 bp, Homo sapiens
  Payload ID: 15921
  Gene Symbol: SNRNP70
  Gene Name: small nuclear ribonucleoprotein 70kDa (U1)
  Uniprot ID: P08621
  ENST ID: ENST00000595231
  CDS Start-End: 153-653
gcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttggtataaggccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgat

SEQ ID NO: 182374 - DNA, 1574 bp, Homo sapiens
  Payload ID: 15921
  Gene Symbol: SNRNP70
  Gene Name: small nuclear ribonucleoprotein 70kDa (U1)
  Uniprot ID: P08621
  ENST ID: ENST00000598441
  CDS Start-End: 225-1538
tttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcg

SEQ ID NO: 182375 - DNA, 4909 bp, Homo sapiens
  Payload ID: 15922
  Gene Symbol: SNRPD1
  Gene Name: small nuclear ribonucleoprotein D1 polypeptide 16kDa
  Uniprot ID: P62314
  ENST ID: ENST00000300413
  CDS Start-End: 164-523
gcgcagcctcggcgtttccgccatgcgcctgcagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatggtttgaacagttcgctgtctttggttggctgaaacttagtgattgccacaagagtagggtaccgtctgtttacacgtccagttaggctacagttctatgtactgagaaacctttaagctgaacttgagatatgtaaagagactttaggctaaacttaacaatatatataggatatatacccttctacttcacatgcactgaatatgcattttattgctttactcttcattctgtggcacctacccacaggggaagtaagaagtttgttttggtatttcggaaactaaagtccttatgggatggggtctagaattgattctcctttcctgagttttactccacggagtcttaggtacctggtaaaaagttgtcttctaaattaagggtcattgctttgttgtctagctgctaatgtcttacttttgtttcttttgctttttaatcagttcttaataggatatagttttatgttttccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagcaaaactgttctaattgttaataaggacttttaaaaattgtttttgatttgctaagctcagaaaaaatgtctctcagtgcatcagttctttgtaaagcttactacgaagtatttatatgctaaggaaaacaactgaggatgtgggtggcttaaatctgtattttcatcatgtatgtgagtttttttttttttaagtaaagaaattttctgcaaagatcgttaccttaaaaaagtttagcctgggtgtggtggctcacgcctgtaatcccagcactttgggaggccgaggcaggtggatcacgaggtcaggagttgaagaccagcttggccaagagggtgaaaccccatttctactaaaaatacaaaagttagccaggtgcagtgacaggcgcctgtaatcccagctactcatgaggccgaggcaggagaattgcttgaacccaggaggcggaggttgcagtgagccgagattgtgccactgcactccagcctgggcgatggagtgagactacgtctcaaaaaaaaatcgagagagagatatatatatgtatttatatatatatgtatttatactaatatataaatatatactaatagatatattagtatacatgtagaatgtacctgtcatatatattagatatataaatgtatatattggtataaataaatactagatatatatttttttaagtatcttacctcatcaagtaaattcaaatgctttttgatttttccacagttgataatttttttttgtaagtcattgaagttatatagtaattagcgttttttcccccacaaattattggcagtggtcacccagttgtattacaggttctatgatccaaaaagggatgtatgaaattcatgatgattaagacaattttttctttctttcttttgagacagagtcttgctgtgtcacccaggctggagtgcagtggtgcgatcttggctcactgcaacctctgcgtcccgggttcaagagattattgtgcctcagcctccagagtagctgggattataagcgtgcgccaccacacccagctaatttttttgtatttttagtagagacggggtttcaccatgttggccagacttaagacaattctttaatagtaaatatattaaaggtgagttggcttgacaagatacaaccaatatgtaatttttctccacacgttttttttttttttttttttttttttctggagacagtcttgctctgttgcccaggctggagtacagtggcgcgatcttggctcactgcaagctctgcctcccgggttcaggccattctcctgcctcagcctcccgagtagctgggactacaggtgcctgccaccacacccagctaattttttgtctttttagtagagacggggtttcactgtgttaggatggtctcgttctcctgacctcatgatctgcacgaggcctcccaatgtgctgggattacaggcgtgagccaccgtgcgtccccggcctatacctttcattaattaataagctgggggaataaataactggatttcattcttttccatcttctgacctgttggtgctcctattgcttgtatccaagtagaaggcaaaaggcaagagacccctgtaatgcagcaagtggagagatttgttgaaggggtcaaacaaaaccctgcaagagtaggaaataaacagttggctcctgtcctcgtggagcttatagacagaagcagataacaaataaaaattggagcttagtgccgtggtgcacacttgtagtccctgctactggggaggctaaggcaagaggatcgctatagcctgggaatttgaagctgtagcgtgctatgattgcaagcagcctgggtaacctagtgagacctggctcttaaatttaaaatttaaatgaaaatggccacttagcataagagatctaaaattacgttttgtcctggcatggtggctcatgcctgtgacctcagcactttgggaggccgagatgggcgaatcacttgaggtcaggagttcgagaccagcctgggtaacatggtgaaaccctgtctactgaaaatacaaaaattagcttggtgtggtggcgggtgcctgtaatctcagttactcaggaggcttaggcaggagaatcacttgaaccctggaggcagaggttgcagtgagctgagatcacaccactgcacttcagcctgagtgacagagcgagactgtttcaaaaaaaaaaaaaaaatttgttttgagagtttttgtgtctaggatgtttgcagtgtgaagccagtctagtaacagtttaaatgtaataataaatcacagtgggtactagattgagtttattccactagaggtcattatttcatttccatgtgaaagggctaaaattgggtgaagaaaaagctatttgaactgattaccatcatttgctataaaggaagcattatagtatgaatagaaaacagactagagtttaacatgcttctcttgacccctcttcaccaccccctaaaaggcagatgggatcttaggactgcagcattttgtacacatctgatatttaatgagatgttacatatgaactttagttttttttcttttcttttcttttcttttcttttctttttttttttttgagacagagtctagctctgtcacccaggctggagtgcagtggtgcaatctcggctcactgcaaactctgcctcccgggttcacgccattctcctgcctcagcctcctgagtagctgagactacaggtgcccaccactatgcccggctaatgttttgtacttttagtagagacggggtttcactgtgttagccaggatggtctgaatctcctgacctcgtgattcgcccgcctcggcctcccaaagtgctgggattacaggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttctttt

SEQ ID NO: 182376 - DNA, 723 bp, Homo sapiens
  Payload ID: 15922
  Gene Symbol: SNRPD1
  Gene Name: small nuclear ribonucleoprotein D1 polypeptide 16kDa
  ENST ID: ENST00000582475
  CDS Start-End: 155-382
ctggagtaggcgcttccggccattcatactgcagtcggtcagtgttcggttgaaggattctgtgtgctgtcggacccagagggtgacggcgccgctaggatgaagctcgtgaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaa

SEQ ID NO: 182377 - DNA, 320 bp, Homo sapiens
  Payload ID: 15922
  Gene Symbol: SNRPD1
  Gene Name: small nuclear ribonucleoprotein D1 polypeptide 16kDa
  ENST ID: ENST00000579618
  CDS Start-End: 117-251
cttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacagtttacctctggatacactacttgtggatgttgaacctaaggtgaaatctaagaaaagggaagctgttgcaggaagaggcagaggaagaggaagaggaagaggacgtggccgtg

SEQ ID NO: 182378 - DNA, 901 bp, Homo sapiens
  Payload ID: 15923
  Gene Symbol: SNRPD2
  Gene Name: small nuclear ribonucleoprotein D2 polypeptide 16.5kDa
  Uniprot ID: P62316
  ENST ID: ENST00000342669
  CDS Start-End: 446-802
agtagatacgtcagtaacgcgtcccagagggaagaggggcggtgcctgtctccgaagcgaggagcggattggcttcacggaggccgcgcccccgaagtcacggccggcgggcatttggaaatagcttgtcatttccctccttcaacctgtaccattcttcaagaaacggtttgaatcagactgcctttccttttgtcttcattgtcataaacatctgcccccgtgtggttctgactggccgcgaacccctacccgaagcttttattccatcattgtgcaccgttggtggggaatgctgtggcaacaggccacgcctccacttactggttggctttgcgcaggcgccaacggaagtgggtcgcaggaagaggaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctagtggta

SEQ ID NO: 182379 - DNA, 615 bp, Homo sapiens
  Payload ID: 15923
  Gene Symbol: SNRPD2
  Gene Name: small nuclear ribonucleoprotein D2 polypeptide 16.5kDa
  Uniprot ID: P62316
  ENST ID: ENST00000391932
  CDS Start-End: 199-525
aggcagcagcaacgcggaggaaacgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgttttttt

SEQ ID NO: 182380 - DNA, 379 bp, Homo sapiens
  Payload ID: 15923
  Gene Symbol: SNRPD2
  Gene Name: small nuclear ribonucleoprotein D2 polypeptide 16.5kDa
  ENST ID: ENST00000585392
  CDS Start-End: 122-286
gggagtgaacggagagcgtagtgaccatcattcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttcta

SEQ ID NO: 182381 - DNA, 702 bp, Homo sapiens
  Payload ID: 15923
  Gene Symbol: SNRPD2
  Gene Name: small nuclear ribonucleoprotein D2 polypeptide 16.5kDa
  Uniprot ID: P62316
  ENST ID: ENST00000588301
  CDS Start-End: 256-612
cgcgtcccagagggaagaggggcggtgcctgtctccgaagcgaggagcggattggcttcacggaggccgcgcccccgaagtcacggccggcgggcatttggaaatagcttgtcatttccctccttcaacctgtaccattcttcaagaaacggcgccaacggaagtgggtcgcaggaagaggaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgttttttt

SEQ ID NO: 182382 - DNA, 596 bp, Homo sapiens
  Payload ID: 15923
  Gene Symbol: SNRPD2
  Gene Name: small nuclear ribonucleoprotein D2 polypeptide 16.5kDa
  Uniprot ID: P62316
  ENST ID: ENST00000587367
  CDS Start-End: 179-505
ggcagcagcaacgcggaggaaacgggagtgaacggagagcgtagtgaccatcattagagaccaggtttcaccatgttggccaagctggtctcaaactcctgacctcaaatgatccacccgcctcgaccttccaaagtgctgggattacaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttc

SEQ ID NO: 182383 - DNA, 805 bp, Homo sapiens
  Payload ID: 15923
  Gene Symbol: SNRPD2
  Gene Name: small nuclear ribonucleoprotein D2 polypeptide 16.5kDa
  Uniprot ID: P62316
  ENST ID: ENST00000588599
  CDS Start-End: 389-715
gcagcgtcctgcttttctcctgatgagtttgagaacgggcgtggggcctttgacgcatcgtgacttcgggagaggggacagctttatcagataacgccctgggctgggcgcgggggctcattcctgtgatcccagcactttagtaggccaaggcggagcatcgctggaacacaggagttcgagactagcctaggcaacatagcgagacccccgtctctacaaaaaaaaaaaaaaatttaattatgaaaaacatgttttaaacgataacgggagtggtcctagataattagtcctattgaaatgaatgttaaggggcagcgattttacgaatactgggggaggccgagcgcggtggctcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgttttttt

SEQ ID NO: 182384 - DNA, 454 bp, Homo sapiens
  Payload ID: 15923
  Gene Symbol: SNRPD2
  Gene Name: small nuclear ribonucleoprotein D2 polypeptide 16.5kDa
  ENST ID: ENST00000590212
  CDS Start-End: 30-266
gggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgatagtgcctcccctccctgttccccaccaggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatg

SEQ ID NO: 182385 - DNA, 1763 bp, Homo sapiens
  Payload ID: 15924
  Gene Symbol: SNRPD3
  Gene Name: small nuclear ribonucleoprotein D3 polypeptide 18kDa
  Uniprot ID: P62318
  ENST ID: ENST00000215829
  CDS Start-End: 588-968
aagcaactctcctccaactgtctttagggataaccctgagcgggcagccgctctactctatacctaactttatccgtaccagatacctagcctcactcagggccccccttacctggcggtgccgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggatcacgaggtcaggagttcgagaccagcctggccaatatggtgaaacctcgtgtgtactaaaaataaaaaaattagccgggtgcggtggcatgtacctgtagtcccagctactcgggaggctgaggcagaagattcgcttgaacccaggaggtggacattgcagtgagcagagatcatgccactgtactccagcttgggtgacagagcgagactgcacctcaaaaaaaaaaaa

SEQ ID NO: 182386 - DNA, 567 bp, Homo sapiens
  Payload ID: 15924
  Gene Symbol: SNRPD3
  Gene Name: small nuclear ribonucleoprotein D3 polypeptide 18kDa
  Uniprot ID: P62318
  ENST ID: ENST00000402849
  CDS Start-End: 84-446
gactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaaggttatctgagttcattggagtgggtgcttgtgcatatatgctaggtcccagagaaaaacctccatgctgggttgatagcagcagctaggatcagttgcccaagactctggattctcgagatgaagaccgtcagcagaggctgatctctcctgtgggctcatgtcc

SEQ ID NO: 182387 - DNA, 715 bp, Homo sapiens
  Payload ID: 15924
  Gene Symbol: SNRPD3
  Gene Name: small nuclear ribonucleoprotein D3 polypeptide 18kDa
  Uniprot ID: P62318
  ENST ID: ENST00000404603
  CDS Start-End: 82-462
ctcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaagtggccgcaagaggaagaggacgtggaatgggacgtggaaacatctttcaaaagcgaagataattttctaagttgaacagaactttgtccttttttctttcaggctctggctccgctactgcatcgtgtgcttctgtccaagaggcagagagactgaaactatctgctgccgcctggattctcccagagattgcctggaacaccagctcgggtcctcgcacaccatcctgcgggtgcagcccagaactgtcttctgaggaagaggtgctctcctgggcccccactgtccccaggcctcagcaaggcaagtgaggtg

SEQ ID NO: 182388 - DNA, 640 bp, Homo sapiens
  Payload ID: 15924
  Gene Symbol: SNRPD3
  Gene Name: small nuclear ribonucleoprotein D3 polypeptide 18kDa
  ENST ID: ENST00000439775
  CDS Start-End: 59-247
ttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggttatctgagttcattggagtgggtgcttgtgcatatatgctaggctctggctccgctactgcatcgtgtgcttctgtccaagaggcagagagactgaaactatctgctgccgcctggattctcccagagattgcctggaacaccagctcgggtcctcgcacaccatcctgcgggtgcagcccagaactgtcttctgaggaagaggtgctctcctgggcccccactgtccccaggcctcagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaa

SEQ ID NO: 182389 - DNA, 1621 bp, Homo sapiens
  Payload ID: 15925
  Gene Symbol: SNRPA
  Gene Name: small nuclear ribonucleoprotein polypeptide A
  Uniprot ID: P09012
  ENST ID: ENST00000243563
  CDS Start-End: 551-1399
ggccaggagagaaagctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 182390 - DNA, 519 bp, Homo sapiens
  Payload ID: 15925
  Gene Symbol: SNRPA
  Gene Name: small nuclear ribonucleoprotein polypeptide A
  ENST ID: ENST00000601253
  CDS Start-End: 134-519
gagaaagctttgtggtttggtctcagggaagtagcaggcgccggttgagagaactacggccctgtcggaaggtaacctccggtgcaaacgaccatcggcggcaggcgagcgacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccc

SEQ ID NO: 182391 - DNA, 695 bp, Homo sapiens
  Payload ID: 15925
  Gene Symbol: SNRPA
  Gene Name: small nuclear ribonucleoprotein polypeptide A
  ENST ID: ENST00000601545
  CDS Start-End: 143-695
gcgagacgcgtacagactcgtgaccttcactgattggtccgtagacccgggcgccacggaaggagagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttca

SEQ ID NO: 182392 - DNA, 592 bp, Homo sapiens
  Payload ID: 15925
  Gene Symbol: SNRPA
  Gene Name: small nuclear ribonucleoprotein polypeptide A
  ENST ID: ENST00000600456
  CDS Start-End: 112-375
cttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgtggtgccatctcagctgactgcaaccttcgcctcctgggttcaagcgattcttctgcctcagcctcttgagtagctgggactacagcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccc

SEQ ID NO: 182393 - DNA, 555 bp, Homo sapiens
  Payload ID: 15925
  Gene Symbol: SNRPA
  Gene Name: small nuclear ribonucleoprotein polypeptide A
  ENST ID: ENST00000599362
  CDS Start-End: 130-555
aagctttgtggtttggtctcagggaagtagcaggcgccggttgagagaactacggccctgtcggaaggtaacctccggtgcaaacgaccatcggcggcaggcgagcgacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccg

SEQ ID NO: 182394 - DNA, 969 bp, Homo sapiens
  Payload ID: 15925
  Gene Symbol: SNRPA
  Gene Name: small nuclear ribonucleoprotein polypeptide A
  ENST ID: ENST00000601393
  CDS Start-End: 201-969
gcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggagcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatct

SEQ ID NO: 182395 - DNA, 538 bp, Homo sapiens
  Payload ID: 15925
  Gene Symbol: SNRPA
  Gene Name: small nuclear ribonucleoprotein polypeptide A
  ENST ID: ENST00000597353
  CDS Start-End: 93-538
agaaagctttgtggtttggtctcagggaagtagcaggcgccggttgagagaactacggccctgtcggaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactca

SEQ ID NO: 182396 - DNA, 1055 bp, Homo sapiens
  Payload ID: 15926
  Gene Symbol: SNRPA1
  Gene Name: small nuclear ribonucleoprotein polypeptide A'
  Uniprot ID: P09661
  ENST ID: ENST00000254193
  CDS Start-End: 74-841
ggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaa

SEQ ID NO: 182397 - DNA, 924 bp, Homo sapiens
  Payload ID: 15926
  Gene Symbol: SNRPA1
  Gene Name: small nuclear ribonucleoprotein polypeptide A'
  ENST ID: ENST00000559309
  CDS Start-End: 27-491
agcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaattttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgcta

SEQ ID NO: 182398 - DNA, 824 bp, Homo sapiens
  Payload ID: 15926
  Gene Symbol: SNRPA1
  Gene Name: small nuclear ribonucleoprotein polypeptide A'
  ENST ID: ENST00000560496
  CDS Start-End: 558-824
ggagccttctgttagcgccgtgcctcttgacaggcacgggtgacttcattacttcctgattctaagcttcatggcactggggacttgagactcgttcagcgttttctctctagtatcttaaacagcggcaagtcatgcgtgacccgacataggtgctagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagac

SEQ ID NO: 182399 - DNA, 625 bp, Homo sapiens
  Payload ID: 15926
  Gene Symbol: SNRPA1
  Gene Name: small nuclear ribonucleoprotein polypeptide A'
  ENST ID: ENST00000559686
  CDS Start-End: 1-429
ctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgatgggttgggtgcagtggctcacgcctgtaatcccagcactttgggagcctgaggcgggcggatcacct

SEQ ID NO: 182400 - DNA, 539 bp, Homo sapiens
  Payload ID: 15926
  Gene Symbol: SNRPA1
  Gene Name: small nuclear ribonucleoprotein polypeptide A'
  ENST ID: ENST00000626000
  CDS Start-End: 78-539
gcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaattt

SEQ ID NO: 182401 - DNA, 2452 bp, Homo sapiens
  Payload ID: 15927
  Gene Symbol: SNRPB2
  Gene Name: small nuclear ribonucleoprotein polypeptide B
  Uniprot ID: P08579
  ENST ID: ENST00000246071
  CDS Start-End: 217-894
tgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagacccaggcaggatctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaagcttgctacttctttgtaattcttaaacaccaatgttcaaatatttccaaagcccattttctttagcttttgatttatgtttaaggctattgattcagtcctctgctgagtaaaccatgggtatctccagaagtggacaatttgtttttacaagtatggtacatattaatagtaacaacaacaaaaaagaaaacagtacttatttttctggtgttcctgttttagtattccttgaacaaaacctttatcacttggaatttttattgtctacttatggaaagacttttagacttacgtagacagtatcacatcactcttatgcatacataaagaggaaaaaaatgtttcctataactttgtcacagttagtctgactcttctgaataacttttttaatcccagtagtcaagctcctgtacttttgtaaaatatattaacagtgaattactagaaaatgggccatgttcttgtatattacagtgatgtcaattgctgataaattttctaactgcttactctcggataccgtacttgtctaagaactgaaaataattcacagactgatcccatgcccagtcctggccatgctttgagtggctgtattggagcagaaaagccagggtggctcacctggggtgagaatgaggggggtgaatagtaagaggggtcgtgtaggtcttcttcaggatttgcttatactctgagtgaaatgggggactattttagagaatttttttaaagtgggttagaatttacgtacaataaagttcacccatgttagtgttcc

SEQ ID NO: 182402 - DNA, 1588 bp, Homo sapiens
  Payload ID: 15927
  Gene Symbol: SNRPB2
  Gene Name: small nuclear ribonucleoprotein polypeptide B
  Uniprot ID: P08579
  ENST ID: ENST00000377943
  CDS Start-End: 140-817
ttctagacttgtcggcgctcgattgaggagcgtggctacgttgcttccggtgcctggctccgtttcctgcttttggttcttacagtagtcggcgtaggccttagattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagacccaggcaggatctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaa

SEQ ID NO: 182403 - DNA, 842 bp, Homo sapiens
  Payload ID: 15928
  Gene Symbol: SNRPC
  Gene Name: small nuclear ribonucleoprotein polypeptide C
  Uniprot ID: P09234
  ENST ID: ENST00000244520
  CDS Start-End: 139-618
gcccctcgctcggctgctggaggcgagggcttcggaagtcttcatgctagtctcgtggggttccgcggtgtcgtcgctggctgtgcgcgtcatttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaa

SEQ ID NO: 182404 - DNA, 1054 bp, Homo sapiens
  Payload ID: 15928
  Gene Symbol: SNRPC
  Gene Name: small nuclear ribonucleoprotein polypeptide C
  ENST ID: ENST00000374017
  CDS Start-End: 288-830
gagtggggccccgaaatctgagggtgatcgtagtcactagttgtggcccccatgcaggagcggagagcgggttctggtttctgaaacctcgagggatgggagagtatctgggccgggtggacggaggcagggagatggagagcgctagacaccccattttagagtgcagatggatcccgcttaaggcaacaaaaaaaagcctggtttatgtgtcgacgctttgatgcttttgagtcgtgaggcggtctggctttttgttttgtttgtttgttttgtttttatcttccatgaacagcgcttccgtggatgggcatctcagtggttgtcgtctttttctcttcctttcacctcttttcaggttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaa

SEQ ID NO: 182405 - DNA, 600 bp, Homo sapiens
  Payload ID: 15928
  Gene Symbol: SNRPC
  Gene Name: small nuclear ribonucleoprotein polypeptide C
  ENST ID: ENST00000374018
  CDS Start-End: 100-456
caacggcctgcagagcaacatgcccaaccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggg

SEQ ID NO: 182406 - DNA, 355 bp, Homo sapiens
  Payload ID: 15929
  Gene Symbol: SNRPE
  Gene Name: small nuclear ribonucleoprotein polypeptide E
  ENST ID: ENST00000367208
  CDS Start-End: 78-236
ttctttttttaacgtttccacttttatgattatttcagagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggc

SEQ ID NO: 182407 - DNA, 942 bp, Homo sapiens
  Payload ID: 15929
  Gene Symbol: SNRPE
  Gene Name: small nuclear ribonucleoprotein polypeptide E
  Uniprot ID: P62304
  ENST ID: ENST00000414487
  CDS Start-End: 46-324
gctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgctggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatatgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagag

SEQ ID NO: 182408 - DNA, 1389 bp, Homo sapiens
  Payload ID: 15930
  Gene Symbol: SNRPF
  Gene Name: small nuclear ribonucleoprotein polypeptide F
  Uniprot ID: P62306
  ENST ID: ENST00000266735
  CDS Start-End: 147-407
ggtgggaggtgaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagctgaaatgatgaaccaattgggaaagattactcactgaactaatgctttaaaagccactgaatttcatttaagttgcttttcttttgtaagcccaatattcttttttttcccataaaggataattatttatatgctttagatatttttatgaaggtgaatttcagaccttttcttgtaaaattatctattagctgagaccttttaaatgcaactttttcttttaaagttatttttgagctacttttaacgtataaaattaaacattttcttggtattaataatatactgtcttattttacttagtagtcaataaattacatgttaattctgtgtcaatataagctaaatgcacatattgcagctaaaattgaagcatcttctaaaaattaaaatgattgtacagacagggcacaacagaaattgggaactgacattcaggctgaaggcatacggtttgttcactgaagagaaaaaagttctctgaacaaaatgtaatgtcaaataaaaaccagtctccccattatgttctgagacataacctcgaggttgagttttaagcccctcaaaacccttcaggtattttagggttgtacattgttaaaatgtatagtccatagtaataacagtatgctatgaacttccctacagatgggttgagaaaatacatcatttacattctcatgttgtaagagaatggccattattacacttcagtgttcatttaccatagttttatcagtaaactatctttgtgtatccccaagtgggacaactcaaagtatagaagaaagtgtttagctatatggaataatacttatgatatgaatacttaaagacttaaaatttacaaaatacacctaagacattctggtaa

SEQ ID NO: 182409 - DNA, 815 bp, Homo sapiens
  Payload ID: 15930
  Gene Symbol: SNRPF
  Gene Name: small nuclear ribonucleoprotein polypeptide F
  ENST ID: ENST00000552085
  CDS Start-End: 106-489
ctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagattttcatctacatcttgggaatattgaaacaaaatggagtttcactctcgtcgcccaggctggagtgcaatggcatgatctcggctcattgcaacctctgtctcccaggttcaagcgattctcctgcctcagcctcccgagtagctgggattacagctaggacctccagaacactgacaaaaagaagtggtgcagtggaaatccttgccttgttcctaatcttagggggaaagcattcagtcttttaccattagatatgtaatgttagtgataagtttctagtagatgtccttttataaagttgaggaacttctcttctgttcctactttgctgagagtctccatcaagaatgaattttggatattgttgagtggtttttctgcatcaattgggataatcatatgggttttcatttttaatttgttaatgtgtattacattgatttatttttaaatgttaaattacttttgtattcttagattaaaccctaatttgtcataatgtattatctttttagtattattggatttggtttgttacattttgttcagaatgtttgcatatttgcttacgagagat

SEQ ID NO: 182410 - DNA, 552 bp, Homo sapiens
  Payload ID: 15930
  Gene Symbol: SNRPF
  Gene Name: small nuclear ribonucleoprotein polypeptide F
  ENST ID: ENST00000553192
  CDS Start-End: 110-313
atttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagattttcatctacatcttgggaatattgaaacaaagtaagattctgctcttccagctctctgaggacttgaagtaactcctctggttccttgaaataaagtgctggctcctaattaatcaataatgaagaatataatttacttaaaaatatgctacctatgcacatgtgacttatctagaaaatacagtggggtaaaggaagacagttctaaggatgagggagacacaggtaggaacttgtatgggaaactcgcctatttccaagtgagagctggctttcagaaagagcacatttgcagtgttgtggggagatga

SEQ ID NO: 182411 - DNA, 625 bp, Homo sapiens
  Payload ID: 15931
  Gene Symbol: SNRPG
  Gene Name: small nuclear ribonucleoprotein polypeptide G
  Uniprot ID: P62308
  ENST ID: ENST00000272348
  CDS Start-End: 123-353
caacaatccattggctaacgaggtcgatgacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacatggcaagga

SEQ ID NO: 182412 - DNA, 428 bp, Homo sapiens
  Payload ID: 15931
  Gene Symbol: SNRPG
  Gene Name: small nuclear ribonucleoprotein polypeptide G
  ENST ID: ENST00000449935
  CDS Start-End: 107-301
tgcaaaatttttacagggatcagttttttctggcgtagcatgtggttggctttgtgtatagttagttcatttattaccaggcccatggaagtcagacaaaagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaa

SEQ ID NO: 182413 - DNA, 527 bp, Homo sapiens
  Payload ID: 15931
  Gene Symbol: SNRPG
  Gene Name: small nuclear ribonucleoprotein polypeptide G
  ENST ID: ENST00000454893
  CDS Start-End: 63-353
ggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggacaacatacctaataaagcggtaagcccaaagttcttgaaaaaggtgaaccaaaaaggacaacttacttttagcaaattattaagcataaagacctccaaggagtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaa

SEQ ID NO: 182414 - DNA, 515 bp, Homo sapiens
  Payload ID: 15931
  Gene Symbol: SNRPG
  Gene Name: small nuclear ribonucleoprotein polypeptide G
  ENST ID: ENST00000438261
  CDS Start-End: 192-386
cgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatacaccaaaccttctagctgctaatactcagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaa

SEQ ID NO: 182415 - DNA, 398 bp, Homo sapiens
  Payload ID: 15931
  Gene Symbol: SNRPG
  Gene Name: small nuclear ribonucleoprotein polypeptide G
  ENST ID: ENST00000413456
  CDS Start-End: 65-271
ggaaggaagtgtttttaaaactacgtgaggcatcagaatccgaaagccactttagtcttagcaaatgtgtttatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaa

SEQ ID NO: 182416 - DNA, 1093 bp, Homo sapiens
  Payload ID: 15931
  Gene Symbol: SNRPG
  Gene Name: small nuclear ribonucleoprotein polypeptide G
  ENST ID: ENST00000482975
  CDS Start-End: 769-963
gcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatagtatcatgttctagatagacggctagagggggaaattctctgaaggaactaaggaggggctggaagggaaggaagtgtttttaaaactacgtgaggcatcagaatccgaaagccactttagtcttagcaaatgtgtttgtaggtgtttgagcttttacttagaaacctcattcctttttcttgccttcttttacgttaagcttgaatgtcatgtgttatcttgctctgatgttgaaactatataagaacattcatttttctttttttttaagaacattaattttttctagtcagagaaggctaattttttgaagttttttctacacacccagtaaagtcaaacaactttaagtaggagagccttactttaggtaggactcaacgtaaagctttgaattcctcaaatactttttgagtggacttaacaggttatgtgtttcctgactacgtttctgttttgcttatacttcctgatgctggaattctacatgtattagttggattgcacaaaggatgcaaaatttttacagggatcagttttttctggcgtagcatgtggttggctttgtgtatagttagttcatttattaccaggcccatggaagtcagacaaaagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaa

SEQ ID NO: 182417 - DNA, 1304 bp, Homo sapiens
  Payload ID: 15932
  Gene Symbol: SNRPN
  Gene Name: small nuclear ribonucleoprotein polypeptide N
  Uniprot ID: P63162
  ENST ID: ENST00000346403
  CDS Start-End: 443-1165
atgctcaggcggggatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtga

SEQ ID NO: 182418 - DNA, 1528 bp, Homo sapiens
  Payload ID: 15932
  Gene Symbol: SNRPN
  Gene Name: small nuclear ribonucleoprotein polypeptide N
  Uniprot ID: P63162
  ENST ID: ENST00000390687
  CDS Start-End: 527-1249
tggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaa

SEQ ID NO: 182419 - DNA, 1605 bp, Homo sapiens
  Payload ID: 15932
  Gene Symbol: SNRPN
  Gene Name: small nuclear ribonucleoprotein polypeptide N
  Uniprot ID: P63162
  ENST ID: ENST00000400097
  CDS Start-End: 745-1467
agctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctgatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 182420 - DNA, 1751 bp, Homo sapiens
  Payload ID: 15932
  Gene Symbol: SNRPN
  Gene Name: small nuclear ribonucleoprotein polypeptide N
  Uniprot ID: P63162
  ENST ID: ENST00000400100
  CDS Start-End: 891-1613
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggagatgtaagtgggatctgtggatctgaaaattcacagtggccagctcaccaccacctgatgaaagatacaccacagggtgagagcatcctaacagcaaactgcaaatgagatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 182421 - DNA, 1763 bp, Homo sapiens
  Payload ID: 15932
  Gene Symbol: SNRPN
  Gene Name: small nuclear ribonucleoprotein polypeptide N
  Uniprot ID: P63162
  ENST ID: ENST00000554227
  CDS Start-End: 934-1668
gatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtagtgacttgtcaggaggatcaatatgaaggacggcctaaacatctccctgcaaatgctttagcagcatctccctcccctcacccctggggagaaaggattgttcacacaggataatttgaaagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgca

SEQ ID NO: 182422 - DNA, 908 bp, Homo sapiens
  Payload ID: 15932
  Gene Symbol: SNRPN
  Gene Name: small nuclear ribonucleoprotein polypeptide N
  ENST ID: ENST00000584968
  CDS Start-End: 731-908
atgctcaggcggggatgtgtgcgaagcctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccag

SEQ ID NO: 182423 - DNA, 1298 bp, Homo sapiens
  Payload ID: 15932
  Gene Symbol: SNRPN
  Gene Name: small nuclear ribonucleoprotein polypeptide N
  Uniprot ID: P63162
  ENST ID: ENST00000577565
  CDS Start-End: 472-1194
cggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataata

SEQ ID NO: 182424 - DNA, 871 bp, Homo sapiens
  Payload ID: 15932
  Gene Symbol: SNRPN
  Gene Name: small nuclear ribonucleoprotein polypeptide N
  ENST ID: ENST00000579070
  CDS Start-End: 364-871
gccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccac

SEQ ID NO: 182425 - DNA, 1109 bp, Homo sapiens
  Payload ID: 15933
  Gene Symbol: SNRPB
  Gene Name: small nuclear ribonucleoprotein polypeptides B and B1
  ENST ID: ENST00000339610
  CDS Start-End: 130-996
tttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacatt

SEQ ID NO: 182426 - DNA, 1154 bp, Homo sapiens
  Payload ID: 15933
  Gene Symbol: SNRPB
  Gene Name: small nuclear ribonucleoprotein polypeptides B and B1
  Uniprot ID: P14678
  ENST ID: ENST00000381342
  CDS Start-End: 164-859
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgca

SEQ ID NO: 182427 - DNA, 1008 bp, Homo sapiens
  Payload ID: 15933
  Gene Symbol: SNRPB
  Gene Name: small nuclear ribonucleoprotein polypeptides B and B1
  Uniprot ID: P14678
  ENST ID: ENST00000438552
  CDS Start-End: 164-886
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgca

SEQ ID NO: 182428 - DNA, 985 bp, Homo sapiens
  Payload ID: 15933
  Gene Symbol: SNRPB
  Gene Name: small nuclear ribonucleoprotein polypeptides B and B1
  ENST ID: ENST00000474384
  CDS Start-End: 43-255
gaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgtgtgaggggggagagcttgagtttctggcctcattgcctatttgtaaagctgtagcctaaagggctctcccaatgcagcctggtctgaaactgctttaagaagcctctgaccctcttcagggccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgagggccccctcccccgggaatgcgcccaccaaggccctagactcatcttggccctcctcagctccctgcctgtttcccgtaaggctgtacatagtccttttatctccttgtggcctatgaaactggtttataataa

SEQ ID NO: 182429 - DNA, 2656 bp, Homo sapiens
  Payload ID: 15934
  Gene Symbol: SNAPC1
  Gene Name: small nuclear RNA activating complex, polypeptide 1, 43kDa
  Uniprot ID: Q16533
  ENST ID: ENST00000216294
  CDS Start-End: 105-1211
acgccgtagggggcgggccgttcgggcttggtttcctgggcgaccaccgctggctagtccgttagaggcgtgcgggcttcggaggcgtgcgggcttcgggtgccatggggactcctcccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgttttccagcatggtattattaagggatttaaagtttgggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctcaaaaaaaaaaaaaagtttgggttgaagatcaaattcgtgatatctctatatctaatctttaaaaatcagaatgctaatgctgacgcaaataaaattttcatttattagca

SEQ ID NO: 182430 - DNA, 1542 bp, Homo sapiens
  Payload ID: 15935
  Gene Symbol: SNAPC2
  Gene Name: small nuclear RNA activating complex, polypeptide 2, 45kDa
  Uniprot ID: Q13487
  ENST ID: ENST00000221573
  CDS Start-End: 52-1056
ctccgcccatcggagaagcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 182431 - DNA, 975 bp, Homo sapiens
  Payload ID: 15935
  Gene Symbol: SNAPC2
  Gene Name: small nuclear RNA activating complex, polypeptide 2, 45kDa
  ENST ID: ENST00000595637
  CDS Start-End: 1-838
gcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctggtgagaagggtgagggagggggcaggagcagagggatcaagggtccctggcagcaggcaggggtgtccccttacccctctcctccatccatcactagagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccg

SEQ ID NO: 182432 - DNA, 1413 bp, Homo sapiens
  Payload ID: 15935
  Gene Symbol: SNAPC2
  Gene Name: small nuclear RNA activating complex, polypeptide 2, 45kDa
  ENST ID: ENST00000597584
  CDS Start-End: 634-927
gcgtgggtgaggcgagggctaaacgggcggaatgaactgggagtaagatgctgccgagtccgggcgaaaagcaacgcatgctgttggacaggatacgagcttgaaatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttca

SEQ ID NO: 182433 - DNA, 753 bp, Homo sapiens
  Payload ID: 15936
  Gene Symbol: SNAPC3
  Gene Name: small nuclear RNA activating complex, polypeptide 3, 50kDa
  ENST ID: ENST00000380799
  CDS Start-End: 11-385
ataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggtaggtgacagcacttaagacattttgttacctttttttttctttatttcagagtacaaaaccagagatagtttttttaaaaataagaggagtaaaagtaataaccattgcaacttggcttgggagcagcaaaaatactgtcttctttccatgcaaataccaactctttccatccatttgcatcctctattgttcattattttggaaaatctttaagaaatactttactattagacggttaaaaatctgttaatactttaaaaagtatctctattttgtattaaatagctgttattcagatatagtacttatccatttatatataacattgcaactttatttttaggtttgtctttttgccaaaatttgaag

SEQ ID NO: 182434 - DNA, 5680 bp, Homo sapiens
  Payload ID: 15936
  Gene Symbol: SNAPC3
  Gene Name: small nuclear RNA activating complex, polypeptide 3, 50kDa
  Uniprot ID: Q92966
  ENST ID: ENST00000380821
  CDS Start-End: 177-1412
gcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatggaaactagggagaatgaattatttacaaataagacaaaattaatagctttgggattatttattttttgagacaaaatctcgctcttgttgcccaggctggaatacagtggcgcaatctcagctcactgcagcctccgcctcccggattcaagtgattctcctgccacagcctcctgagtagctgggattgcaggcacctggcaccatgcctggctaatttttgtatttttagtagagacggggtttcaccatgttggccaggctggtctcaaactcctaacctcaggcgatccacccgcctaagcctcccaaaattttgggatcacaggcgtgagccaccgcgcccggctgctttgggggaatttaatcttagtgtgctgtttagtaatgttaggttttgttttggaggaaactaggcatacaagacatgttaataagactatgtgaataatgaatttaaaaagatcttgagtatatactcataactccagaaataacattaacttgaagctttatttcttgacaaaagctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttattcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcagtatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctgatttaagacagcttttctcttttttcgaggcagcttttctttatgcttatttcaatcaaatgtaacacgcctgtcaaattacatgtaacacattagctaatgaagataggcaactgaaaatgttgtcatgaacatgtcaacctgcttggtagttgaatttgacttttatataatagtggatacacatgcacagaagttactagagaagcaatagctatttctttaaacattcttcaggcatcagtaccatttaaggacaattagacattctagttttactaggagaaaggtcagtcatctctaacattgtgttgcagaattacacgacacaaacataaacacatttctgcctattaaaccagtttctttgtttctaaagagtttaatgatacaggtttgctatttccattagagcatcctttttctggccaatcggacaaaatagagttagcaaagccctcacagcaccctatgaaaaatctctgctcttatacaggattagatgcagacctcatcttgacctaacatctgtaaccaggtaagtgtatgagtaggaacacagacagcagtactgtatcagcaaaatctatcatattatttgaaatcactggatataatattaattataaagtgtatggttctctccagttgttcacataccaaatcccagtcagttctcagattcagatagatgtatctgcaatttctccaagcagctaagaaaaccttcaatggtcagttctgcttggtcatggtatgactctttttttttttttttttttttttttttgagatggagtcttgctctgtctcccaggctggagtgcagtggggcaatctcagctcactgcaacctctgcctcccgggttcaagcaattctcctgcctcagcctcccgaggagctgggattacaggcacgtgccactgcgcccggctgatgtatgactcttttatccagtaatcaaaacacatacgtacatacacacacataccagcccaaaagaggtgttaaaacatacatattacacgtactttttggaggggtggggtggggtggggtggggtggggtgggggttatctatctcaaaattaccttttggtgccttgtcaagctgtggagttttgaccacacacacaaattgagccaatgaacaatttcaatgatcctgaaagttcttaagtcttatgaataattatcaagagttctgagaagttatctgtaaatcagcctatgacaccatttcttgagagttatgattaaagaaacagcaattatgcttgaagcgaacatacatcaactagttagagcaaggtcagcctgtacaagctgacataaattatgagaatgatgctctatctctagaattggaatattctgtggcttctttgtaaaactatagatctggtgggtcatgggaagaaagggagggtgaacaaaagataaatattacctttattttttatcatcttgagcttactgtttagttaccccgtttcccaaaacagcacaacctctgtgaccagttaactaagaaattatttccttggcagcaaacccagaattccatcacttactcttgtaaatagcaagaaagtaatttactagcagagtttgatagaaaaattctttaatgaaaacaagtttacacgttgaacttatggcttaactagaataaatct

SEQ ID NO: 182435 - DNA, 730 bp, Homo sapiens
  Payload ID: 15936
  Gene Symbol: SNAPC3
  Gene Name: small nuclear RNA activating complex, polypeptide 3, 50kDa
  ENST ID: ENST00000421710
  CDS Start-End: 2-730
catggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataaggacctatacaaatcagccttcttttattttgaaggaacattttataatgataaaagatacccagaatgcagagatttgagcagaactatcattgagtggtcagagtcccatgatagaggctatggaaagtttcagactgctagaatg

SEQ ID NO: 182436 - DNA, 2524 bp, Homo sapiens
  Payload ID: 15936
  Gene Symbol: SNAPC3
  Gene Name: small nuclear RNA activating complex, polypeptide 3, 50kDa
  Uniprot ID: Q92966
  ENST ID: ENST00000490969
  CDS Start-End: 12-1247
gtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcagtatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctgatttaaga

SEQ ID NO: 182437 - DNA, 2574 bp, Homo sapiens
  Payload ID: 15936
  Gene Symbol: SNAPC3
  Gene Name: small nuclear RNA activating complex, polypeptide 3, 50kDa
  Uniprot ID: Q92966
  ENST ID: ENST00000467062
  CDS Start-End: 147-1382
atggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctgagcatcctttttctggccaatcggacaaaatagagttagcaaagccctcacagcaccctatgaaaaatctctgctcttatacaggattagatgcagacctcatcttgacctaacatctgtaaccaggtatgtcaacctagttatctagtgtagaatccttcagagatatttcagtctctctctcttcactggatggcctgaagaaaagggggaaaggtacaactggaattaggattttctcctgatgaaggaaaaaaagacattaagtctgcattatatttttaaacccatgaaaagactgaaaccaaccaaacaaaagaaaaacttgacttgttattagaacagtcattattatttttttcttcttcaaaactgttattttaccatgttgtatcttcttcccaaagtaatatgcagatgaagcaaaataactcagcaaagtgtcatggaccaagccctttccatcatttctagcataaaagtgaattctctttaaagaacatgagaatgttttatatctgtgataccaacatatttcaaaatcttaataaaaagagaggttgatacaca

SEQ ID NO: 182438 - DNA, 2453 bp, Homo sapiens
  Payload ID: 15936
  Gene Symbol: SNAPC3
  Gene Name: small nuclear RNA activating complex, polypeptide 3, 50kDa
  Uniprot ID: Q92966
  ENST ID: ENST00000610884
  CDS Start-End: 147-1382
atggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctgagcatcctttttctggccaatcggacaaaatagagttagcaaagccctcacagcaccctatgaaaaatctctgctcttatacaggattagatgcagacctcatcttgacctaacatctgtaaccaggtatgtcaacctagttatctagtgtagaatccttcagagatatttcagtctctctctcttcactggatggcctgaagaaaagggggaaaggtacaactggaattaggattttctcctgatgaaggaaaaaaagacattaagtctgcattatatttttaaacccatgaaaagactgaaaccaaccaaacaaaagaaaaacttgacttgttattagaacagtcattattatttttttcttcttcaaaactgttattttaccatgttgtatcttcttcccaaagtaatatgcagatgaagcaaaataactcagcaaagtgtcatgg

SEQ ID NO: 182439 - DNA, 5010 bp, Homo sapiens
  Payload ID: 15937
  Gene Symbol: SNAPC4
  Gene Name: small nuclear RNA activating complex, polypeptide 4, 190kDa
  Uniprot ID: Q5SXM2
  ENST ID: ENST00000298532
  CDS Start-End: 370-4779
acaccttctacgctgggtggccagtttccatgtggcttggtgtgggagcagagacgggacagtggggcctgtccttgttcatccactccctgcctgtgctggttgcagcctcagagcaggcgggagatgttcttggggcttaggctcctggcagagcacatagcaggagtttgtggggtctgaggttcctgtcccagggttccccgattctgtgcctggcctattaatctttctctggggagcccagtgcccactgccgagcaggctcctgccatcccccatgggcgggtgtgtctgaaggagaatgggatcccggcacggtcttggtttctaacatctcggggtgtgttttggaggcaggcgggagtcatggatgtagatgctgaaagagagaagataacacaggagatcaaggagctggaaaggattttggatcccggctcctcgggctcccacgtggagatctcagaatcaagtctcgagtcagattctgaagcagattcactgccttctgaggacttggatcctgccgatcccccgatctcggaagaagaaaggtggggcgaagccagcaatgacgaggacgatcccaaggataaaaccctccctgaagacccagaaacctgcctgcagctgaacatggtctaccaggaggtcatccaggagaagctggctgaggccaacctgctgctggcccagaaccgggagcagcaggaggaactcatgagggatctggctgggtccaaaggcaccaaggtgaaagatggcaaaagcctgcccccaagcacatacatggggcacttcatgaagccgtatttcaaggacaaggtcacgggcgtggggccacctgccaacgaggacacacgagagaaggctgcccaggggatcaaggctttcgaggagctccttgtgaccaaatggaaaaactgggaaaaggccttgctccgaaagtcagtggtgagtgaccgcctgcagcgattgcttcagcccaagttactgaagctcgagtacttgcaccagaagcagagcaaagtctccagtgagctggagaggcaagccctggagaagcagggcagggaagccgagaaggagatccaggacatcaaccagcttccagaagaggccttgctgggaaacaggctggacagccacgactgggagaagatttccaatattaactttgaaggcagccgcagtgcagaggagatccggaagttctggcagaactcggagcaccccagcatcaacaagcaggagtggagcagggaggaggaggagcggctgcaggcgatcgcggctgcacacggccacctggagtggcagaagattgcagaggagctggggaccagccgcagcgccttccagtgcctgcagaaattccagcagcacaacaaagctctgaaacgcaaggagtggacagaggaggaggaccgcatgctcacgcagctggtgcaggagatgcgcgtcggcagccacatcccctaccgcagaattgtctactatatggaagggagagactccatgcagctgatctaccgatggaccaagagcttggatcctggtctgaagaagggttactgggccccggaggaagatgctaagttgcttcaagctgttgccaaatacggggagcaggattggtttaaaatccgggaagaggtgccaggtaggagcgatgcccagtgccgagatcggtatctcaggagattacatttcagcttgaaaaagggtcggtggaatttaaaagaagaggaacagttaattgaattaatagaaaaatatggtgtcggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccacatcgatactgccggctgcttggaggtcgtccgagagaggaaggccctgccacccaggctgccccaggctggtgctcgggacccaccagttcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcggcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtgga

SEQ ID NO: 182440 - DNA, 794 bp, Homo sapiens
  Payload ID: 15938
  Gene Symbol: SNAPC5
  Gene Name: small nuclear RNA activating complex, polypeptide 5, 19kDa
  Uniprot ID: O75971
  ENST ID: ENST00000307979
  CDS Start-End: 32-238
agcccggaggttggctatgtgaccaggcaacatgctgagccggcttcaggaactgcgcaaggaggaggagacgctgctgcggttgaaggcagccctgcacgaccagctgaaccgcctcaagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccgtctgagagcacaagctgtttctacctctcagaggcattgaaatattgcatgctataaactgctttgtgtatctgttaccac

SEQ ID NO: 182441 - DNA, 1002 bp, Homo sapiens
  Payload ID: 15938
  Gene Symbol: SNAPC5
  Gene Name: small nuclear RNA activating complex, polypeptide 5, 19kDa
  Uniprot ID: O75971
  ENST ID: ENST00000316634
  CDS Start-End: 83-379
tttccgggagtcggcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccgtctgagagcacaagctgtttctacctctcagaggcattgaaatattgcatgctataaactgctttgtgtatctgttaccacctctcacttgagacatcactcactggtaaaatgttttataaataaatttataagtagccatcatgga

SEQ ID NO: 182442 - DNA, 749 bp, Homo sapiens
  Payload ID: 15938
  Gene Symbol: SNAPC5
  Gene Name: small nuclear RNA activating complex, polypeptide 5, 19kDa
  Uniprot ID: O75971
  ENST ID: ENST00000395589
  CDS Start-End: 20-316
ggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtgaaatgcacatctgaacagagacaggcatgggaaggaggcccaaaagcgacatggcaaaccaccgggcaggggactcgctctttgttgcttcccaaacacttagacgccagcagcatgggttggtgtgctgggctggttaaggccgatggtggagcagagccaacctgcaaaatccacttcctcagcatcagatctcttgataaaagcatgaacctgcatgtaaggaaacgagaggacgtggtgttaaaaagaaacaaaaaaacaaaacccaccaggaaggaaaatccaagagtttcaggtctagagcttgtgctgcacttggaaagagcacctggcacctgcccctgagcaacagtggggccagctgcaggcccaaagacctgctccaccagtcacagcagctgtgagg

SEQ ID NO: 182443 - DNA, 587 bp, Homo sapiens
  Payload ID: 15938
  Gene Symbol: SNAPC5
  Gene Name: small nuclear RNA activating complex, polypeptide 5, 19kDa
  Uniprot ID: O75971
  ENST ID: ENST00000562411
  CDS Start-End: 50-346
gagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtgaaatgcacatctgaacagagacaggcatgggaaggaggcccaaaagcgacatggcaaaccaccgggcaggggactcgct

SEQ ID NO: 182444 - DNA, 1069 bp, Homo sapiens
  Payload ID: 15938
  Gene Symbol: SNAPC5
  Gene Name: small nuclear RNA activating complex, polypeptide 5, 19kDa
  ENST ID: ENST00000565465
  CDS Start-End: 29-232
ccggaggttggctatgtgaccaggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagttctccgctactcactagctgtggtggcgccaatttagaggtttacaaacaaacaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccgtctgagagcacaagctgtttctacctctcagaggcattgaaatattgcatgctataaactgctttgtgtatctgttaccacctctcacttgagacatcactcactggtaaaatgttt

SEQ ID NO: 182445 - DNA, 1741 bp, Homo sapiens
  Payload ID: 15938
  Gene Symbol: SNAPC5
  Gene Name: small nuclear RNA activating complex, polypeptide 5, 19kDa
  ENST ID: ENST00000568875
  CDS Start-End: 50-301
gagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatgtaagcttaatcaagtgcaggcctaggagagaatgcaaagtctgctctgctcccatgctgcttgggtggtgaagaactgttgtaaatcacattacctagcccaaagggctctgagaagtgctgataacagttttctggtttaataaggtggcaactctccattaaccaccttcctaccagctagttatacactaattaattaagtagttactaatgttttacctccatcctcctcgtcatccattctgtctagttactcagatgaacccgggggagagtggagatttttgtaggacgatgtcaaaactcttgattttttgtgaataagtaaccttgagattcaagagtgtggcttcaagtacaaggcacagtgctaaaagatgagctccagttctcatcatactcatctcttaccaaatgccctcaaatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccgtctgagagcacaagctgtttctacctctcagaggcattgaaatattgcatgctataaactgctttgtgtatctgttaccacctctcacttgagacatcactcactggtaaaatgttttataaataaatttataagtagccatcatggagcctgctggtttctagatagcgacagagagaagcagcagttccttctctgaggaaaagatacaacaggatggtttgaaatccatttctggtccttaagagagatgtgccatgcttggaagactggattttttgttttgttttttgttttgttttgtttgagacggagtttcactcttattgcccaggctggagtgcaatggcgcgattttggctcactgcaacctccccttctcgggttcaagtgattcttctgcctcagcctccagagtagctaggattacaggcatgcaccaccacacccggctaattttgtatttttagtaaagatgggatttttccatgtt

SEQ ID NO: 182446 - DNA, 574 bp, Homo sapiens
  Payload ID: 15938
  Gene Symbol: SNAPC5
  Gene Name: small nuclear RNA activating complex, polypeptide 5, 19kDa
  ENST ID: ENST00000566658
  CDS Start-End: 8-211
aggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagttctccgctactcactagctgtggtggcgccaatttagaggtttacaaacaaacagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctg

SEQ ID NO: 182447 - DNA, 920 bp, Homo sapiens
  Payload ID: 15938
  Gene Symbol: SNAPC5
  Gene Name: small nuclear RNA activating complex, polypeptide 5, 19kDa
  Uniprot ID: O75971
  ENST ID: ENST00000563480
  CDS Start-End: 20-316
ggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtgaaatgcacatctgaacagagacaggcatgggaaggaggcccaaaagcgacatggcaaaccaccgggcaggggactcgctctttgttgcttcccaaacacttagacgccagcagcatgggttggtgtgctgggctggttaaggccgatggtggagcagagccaacctgcaaaatccacttcctcagcatcagatctcttgataaaagcatgaacctgcatgtaaggaaacgagaggacgtggtgttaaaaagaaacaaaaaaacaaaacccaccaggaaggaaaatccaagagtttcaggtctagagcttgtgctgcacttggaaagagcacctggcacctgcccctgagcaacagtggggccagctgcaggcccaaagacctgctccaccagtcacagcagctgtgaggccttgggcaagtcacctcttggagcctactcgtgcagtatggagacagtaactctgccttaaatgcctcacaggcttgttagaagggacaaagaaaatgatggacttagtgcatattatatactatatacaccgtctatggctgtccagatatttacagtattacttagct

SEQ ID NO: 182448 - DNA, 270 bp, Homo sapiens
  Payload ID: 15939
  Gene Symbol: SPRR1A
  Gene Name: small proline-rich protein 1A
  Uniprot ID: P35321
  ENST ID: ENST00000368762
  CDS Start-End: 1-270
atgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccagcaccagcccagcagaagaccaagcagaagtaa

SEQ ID NO: 182449 - DNA, 620 bp, Homo sapiens
  Payload ID: 15940
  Gene Symbol: SPRR1B
  Gene Name: small proline-rich protein 1B
  Uniprot ID: P22528
  ENST ID: ENST00000307098
  CDS Start-End: 66-335
caccagttctaagggaccatacagagtattcctctcttcacaccaggaccagtcactgttgcagcatgagttcccagcagcagaagcagccttgcaccccaccccctcagcttcagcagcagcaggtgaaacagccttgccagcctccacctcaggaaccatgcatccccaaaaccaaggagccctgccaccccaaggtgcctgagccctgccaccccaaagtgcccgagccctgccagcccaaggttccagagccatgccaccccaaggtgcctgagccctgcccttcaatagtcactccagcaccagcccagcagaagaccaagcagaagtaatgtggtccacagccatgcccttgaggagccggccaccagatgctgaatcccctatcccattctgcgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattcca

SEQ ID NO: 182450 - DNA, 709 bp, Homo sapiens
  Payload ID: 15941
  Gene Symbol: SPRR2A
  Gene Name: small proline-rich protein 2A
  Uniprot ID: P35326
  ENST ID: ENST00000392653
  CDS Start-End: 87-305
agagatcctctgctgcacgactcttaaacccctggtacctgagcactgatctgccttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatatatatttgt

SEQ ID NO: 182451 - DNA, 617 bp, Homo sapiens
  Payload ID: 15942
  Gene Symbol: SPRR2B
  Gene Name: small proline-rich protein 2B
  Uniprot ID: P35325
  ENST ID: ENST00000368755
  CDS Start-End: 2-220
gatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagccaaagtatccaccgaagagcaagtaacagcttcaggattcatcaggagcatgagaggataaggataattggctcacctcgttccacagctccaccttcatcttctcatcaaagcttatcatggattcatagggagcttctttccccttagcctgtgatctgcccatgatgttccctgatagcaaaaggtttcctttctaaggctgccatactgccactgtccaggtggagactgagcaaaggaaccttggctttgtcagttcccagagcttcagcagaaagagctgcagctgtgtgcctgggaaccatcagagaattctgttgatgtgttctgtgtctgtctttcacctgggcatgagcttctaccacctgtgcaattgtcacttttctttcactccctgaataaagtatctatgcatatata

SEQ ID NO: 182452 - DNA, 682 bp, Homo sapiens
  Payload ID: 15943
  Gene Symbol: SPRR2D
  Gene Name: small proline-rich protein 2D
  Uniprot ID: P22532
  ENST ID: ENST00000360379
  CDS Start-End: 61-279
aactcctggtactctagcaccgatctgctttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgatgtgttctgtgtctgtctgtcacctggtcatgagcttctaccacctttgcaattgtcatttatctttcactccctgaataaagtatctatgcatatatatttgt

SEQ ID NO: 182453 - DNA, 788 bp, Homo sapiens
  Payload ID: 15943
  Gene Symbol: SPRR2D
  Gene Name: small proline-rich protein 2D
  Uniprot ID: P22532
  ENST ID: ENST00000368756
  CDS Start-End: 290-508
ctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtgccaagagcctgcaatccttcccaaacagccctttgttctgtgctcaagtcaacccactgggactttactacagataatgataagagaaatggcttgtgagattgctcatgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaac

SEQ ID NO: 182454 - DNA, 800 bp, Homo sapiens
  Payload ID: 15943
  Gene Symbol: SPRR2D
  Gene Name: small proline-rich protein 2D
  Uniprot ID: P22532
  ENST ID: ENST00000368757
  CDS Start-End: 282-500
aggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtaaaaatctgaggttttatctgagaaaaaggtggcaaagaaaatttcagtcttgaacagggtcagcagatagcacaatgtggtcagcctgcaaacccagagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgat

SEQ ID NO: 182455 - DNA, 782 bp, Homo sapiens
  Payload ID: 15943
  Gene Symbol: SPRR2D
  Gene Name: small proline-rich protein 2D
  Uniprot ID: P22532
  ENST ID: ENST00000368758
  CDS Start-End: 180-398
aggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatatagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgatgtgttctgtgtctgtctgtcacctggtcatgagcttctaccacctttgcaattgtcatttatctttcactccctgaataaagta

SEQ ID NO: 182456 - DNA, 678 bp, Homo sapiens
  Payload ID: 15944
  Gene Symbol: SPRR2E
  Gene Name: small proline-rich protein 2E
  Uniprot ID: P22531
  ENST ID: ENST00000368750
  CDS Start-End: 62-280
aaactcctggtacttgagcactgatctgctttggagaacctgattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagcttcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttttctttcactccctgaataaaatatctttgcatacgta

SEQ ID NO: 182457 - DNA, 692 bp, Homo sapiens
  Payload ID: 15944
  Gene Symbol: SPRR2E
  Gene Name: small proline-rich protein 2E
  Uniprot ID: P22531
  ENST ID: ENST00000368751
  CDS Start-End: 76-294
gaaagtgtctgttcttgtcttttgttcacttttcaaaggggctgtttatttttcatattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagcttcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttttctttcactccctgaataaaatatctttgcatacgta

SEQ ID NO: 182458 - DNA, 681 bp, Homo sapiens
  Payload ID: 15945
  Gene Symbol: SPRR2F
  Gene Name: small proline-rich protein 2F
  Uniprot ID: Q96RM1
  ENST ID: ENST00000468739
  CDS Start-End: 62-280
aaactcctggtacctaagcaccgatctgccttggagaacctgattctgagactccagcaggatgtcttatcaacagcagcagtgcaagcagccctgccagccacctcctgtgtgccccgcgccaaagtgcccagagccatgtccacccccgaagtgccctgagccctgcccaccatcaaagtgtccacagtcctgcccacctcagcagtgccagcagaaatgtcctcctgtgacaccttccccaccctgccagccaaagtgtccacccaagagcaagtaacagcttcaggattcatcaggagcatgaaaggataaggataattggctcacctcgttccacagctccacctgcatcttctcatcaaagccatccagggatacacagggagcttctttcctcttagcctgtgatcggcctgtgatgatctctgatagcaaaaggttttctttttgaggctgccatactgccactgtccaggtggagactgagcaaaggaagtcctgggctgtgccagctcccagagcttcagaagaaagagcagctctctccctgggaaccattagagaattctgttgatgttttctgtgtctgtctgtcccctgggcatgagcttccaccacctgtgcagttgtcactttcctttcactccctgaataaagaatctatgcatatatatttgt

SEQ ID NO: 182459 - DNA, 568 bp, Homo sapiens
  Payload ID: 15946
  Gene Symbol: SPRR2G
  Gene Name: small proline-rich protein 2G
  Uniprot ID: Q9BYE4
  ENST ID: ENST00000368748
  CDS Start-End: 40-261
agatctttgaagactctgattctctgagactgaggagagatgtcttaccagcagcagcagtgcaagcagccctgccagccacctcctgtgtgccccacgccaaagtgcccagagccatgtccacccccgaagtgccctgagccttacctgcctcctccttgtccacctgagcattgcccacctccaccatgccaggataaatgccctcctgtgcaaccatacccaccctgccagcagaagtatccacccaagagcaagtaacatcactagaattcatcaggaccatgaaacaacaagatccagtggctcttcttactcccaggactccatcatcttcccttcagctgtagtgggaggctgcatcttccctaacctctgtctggcttgagcgttgacagagaaaaggcttagttctgaaaaccgatatgttgttggaagatgagcagccagatcactgcctaatctcgctttgctgtctgtgatgtagatggtggttcctatcctgagagcaagtgtgtttattcttttgcttctccccaataaagcacatgtttcatggtcaagccca

SEQ ID NO: 182460 - DNA, 878 bp, Homo sapiens
  Payload ID: 15947
  Gene Symbol: SPRR3
  Gene Name: small proline-rich protein 3
  Uniprot ID: Q9UBC9
  ENST ID: ENST00000295367
  CDS Start-End: 43-552
cctcgaccttctctgcacagcaggtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagcacattgtcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctcttccctcattaaattgcttttaattcca

SEQ ID NO: 182461 - DNA, 985 bp, Homo sapiens
  Payload ID: 15947
  Gene Symbol: SPRR3
  Gene Name: small proline-rich protein 3
  Uniprot ID: Q9UBC9
  ENST ID: ENST00000331860
  CDS Start-End: 151-660
tcaccagatcccagaggctgaacacctcgaccttctctgcacagcagatgatccctgagcagctgaagaccagaaaagccactaagactttctgcttaattcaggagcttagaggattcttcaaagagtgtgtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagcacattgtcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctcttccctcattaaattgcttttaattcc

SEQ ID NO: 182462 - DNA, 622 bp, Homo sapiens
  Payload ID: 15947
  Gene Symbol: SPRR3
  Gene Name: small proline-rich protein 3
  ENST ID: ENST00000443178
  CDS Start-End: 147-622
cagatcccagaggctgaacacctcgaccttctctgcacagcagatgatccctgagcagctgaagaccagaaaagccactaagactttctgcttaattcaggagcttagaggattcttcaaagagtgtgtccagcatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactcc

SEQ ID NO: 182463 - DNA, 733 bp, Homo sapiens
  Payload ID: 15948
  Gene Symbol: SPRR4
  Gene Name: small proline-rich protein 4
  Uniprot ID: Q96PI1
  ENST ID: ENST00000328051
  CDS Start-End: 50-289
ctctcctggggtccagcttgtcgcctctggctcacctgttcctagagcaatgtcttcccagcagcagcagcggcagcagcagcagtgcccaccccagagggcccagcagcagcaagtgaagcagccttgtcagccaccccctgttaaatgtcaagagacatgtgcacccaaaaccaaggatccatgtgctccccaggtcaagaagcaatgcccaccgaaaggcaccatcattccagcccagcagaagtgtccctcagcccagcaagcctccaagagcaaacagaagtaaggatggactggatattaccatcatccaccatcctggctaccagatggaaccttctcttcttccttctcctcttccctccagctcttgagcctaccctcctctcacatctcctcctgcccaagatgtaaggaagcattgtaaggatttcttcccatcgtacccttccccacacataccaccttggcttcttctatatcccaccccgatgctctcccaggtgggtgtgagagagacctcattctctgcaggctccagcgtggccacagctaaggcccatccatttcccaaagtgaggaaagtgtctgggcttcttctggggttccaccctgacaagtagggtcacagaggctggtgcacagtttctgcctcattcctctccatgatgccccctgctctgggcttctctcctgttttccccaataaatatgtgcctcatgtaataaa

SEQ ID NO: 182464 - DNA, 831 bp, Homo sapiens
  Payload ID: 15949
  Gene Symbol: SUMO1
  Gene Name: small ubiquitin-like modifier 1
  Uniprot ID: P63165
  ENST ID: ENST00000392244
  CDS Start-End: 116-346
gcagccgcggtgttgtgctgtggggaagggagaaggatttgtaaaccccggagcgaggttctgcttacccgaggccgctgctgtgcggagacccccgggtgaagccaccgtcatcatgtctgaccaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagagga

SEQ ID NO: 182465 - DNA, 1071 bp, Homo sapiens
  Payload ID: 15949
  Gene Symbol: SUMO1
  Gene Name: small ubiquitin-like modifier 1
  Uniprot ID: P63165
  ENST ID: ENST00000392245
  CDS Start-End: 149-454
gcggaagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgcc

SEQ ID NO: 182466 - DNA, 1536 bp, Homo sapiens
  Payload ID: 15949
  Gene Symbol: SUMO1
  Gene Name: small ubiquitin-like modifier 1
  Uniprot ID: P63165
  ENST ID: ENST00000392246
  CDS Start-End: 158-463
ctgcgcgaagcggaagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaatt

SEQ ID NO: 182467 - DNA, 534 bp, Homo sapiens
  Payload ID: 15949
  Gene Symbol: SUMO1
  Gene Name: small ubiquitin-like modifier 1
  ENST ID: ENST00000409205
  CDS Start-End: 124-312
ccaccgtcatcatgtctgaccaggaggcaaaaccttcaactgaggacttgggggataagaaggaaggtgaatatattaaactcaaagtcattggacagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctccttttt

SEQ ID NO: 182468 - DNA, 761 bp, Homo sapiens
  Payload ID: 15949
  Gene Symbol: SUMO1
  Gene Name: small ubiquitin-like modifier 1
  ENST ID: ENST00000409712
  CDS Start-End: 126-359
ggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagctgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttc

SEQ ID NO: 182469 - DNA, 779 bp, Homo sapiens
  Payload ID: 15949
  Gene Symbol: SUMO1
  Gene Name: small ubiquitin-like modifier 1
  ENST ID: ENST00000409498
  CDS Start-End: 346-534
gaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggctctgtggattagactcacctctgcttcttggtgtgtggggcctcagctgagatgactcaagtggctgggggctggaacagctagttgtcaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagag

SEQ ID NO: 182470 - DNA, 722 bp, Homo sapiens
  Payload ID: 15949
  Gene Symbol: SUMO1
  Gene Name: small ubiquitin-like modifier 1
  ENST ID: ENST00000409627
  CDS Start-End: 116-337
gcagccgcggtgttgtgctgtggggaagggagaaggatttgtaaaccccggagcgaggttctgcttacccgaggccgctgctgtgcggagacccccgggtgaagccaccgtcatcatgtctgaccaggaatcacttaaccctgaaagtcttgtgagaagacatggcgagaagtggagtcaagcacacaccatgatggcagataaaggaagagaggccgataatcttttttttttgagacggagtctcgctctgtcacccagtctggagtgcagtggtgccatctcgactcgctgcaacctccgcctcccaggttcaagaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttg

SEQ ID NO: 182471 - DNA, 784 bp, Homo sapiens
  Payload ID: 15949
  Gene Symbol: SUMO1
  Gene Name: small ubiquitin-like modifier 1
  ENST ID: ENST00000409181
  CDS Start-End: 119-295
actgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcag

SEQ ID NO: 182472 - DNA, 1187 bp, Homo sapiens
  Payload ID: 15949
  Gene Symbol: SUMO1
  Gene Name: small ubiquitin-like modifier 1
  ENST ID: ENST00000409368
  CDS Start-End: 144-584
agtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaagcacagtggcccacgcctgcaatcctagcactttgggaggctgaggcgggctggatcactgcaggtcaggagttgagaccagcctgggcaacatggcgaaacctcatctctactaaaaatagaaaaagtagccagctgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccaga

SEQ ID NO: 182473 - DNA, 809 bp, Homo sapiens
  Payload ID: 15950
  Gene Symbol: SUMO2
  Gene Name: small ubiquitin-like modifier 2
  Uniprot ID: P61956
  ENST ID: ENST00000314523
  CDS Start-End: 123-338
tcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataactt

SEQ ID NO: 182474 - DNA, 3190 bp, Homo sapiens
  Payload ID: 15950
  Gene Symbol: SUMO2
  Gene Name: small ubiquitin-like modifier 2
  Uniprot ID: P61956
  ENST ID: ENST00000420826
  CDS Start-End: 150-437
gggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaatgagctgttttctttattctgagaaatattaaatagaaaattgaggcttagaaaaaacataaataggcctgcttagaagtaacatttcaagaaggaaataaagctacttggtgtttctgacagactgatactgatgccaaacaaagaataacagttttataaatatcaccttgttccaaaagtttctctaggtcccatgttaatatgcaagtatactagcagaaaaattgggccatagtatcgtggatttccaggtattttctgtatattaagtgaggcacggagcatagggtatagggtagcacatgtggcaaggaaaaagttctgattttgcctttgttgctgataaaacactgaaccattctagcctgcacttatcataagtaaatactccctaacctaaaataaagttttcgttccttattcaaggattttttttttgagacggagttttcctcttgttgcccaggctggagtgtagtggtgcaatttcagctcactgcaacctcagcctcctgagtagctggggggtcataggtgcatgccaccacgcccagctaattttttttctatttttagtcgagacagggttttatcacgtatgccaggctggtctcgaactcctgaccttaggtgatccacccgcctcagcctcccaaagtgcagggattacggcatgagccaccacgcctggcctattcaagaatattgagggacagaaaatatctatatatatccatcctcagaaccttaaatatacaggtcactacagtctttattattttaatttttgtttcttagggtttcttttggtggtggttttttgagatggagcatcattccgtctcccaggctgtagtgcagtggcacaatcttggctcactgcaagctccgcctcccgggttcacgccattctcctgcctcagcctcccgtcttaggtctttttgaaagaggttatgcctctgttgcctagtctggagtggtgcaatggtgtgatcttggctcactgcaacctccacctccaggtcttaagagatcctccctgctcagcctcgtgagtagctagaaccgcaggtgcatgccaccacagctaattcttgtattttttatagagagtgtttcgccatattgtccaggccgggctcaaacccctgatcttaagtgatctatctgccttagcctcccaatgtgctgggtttacaggcgtgagccactatgcccagcccctttttaattttttaaaaatgtttatttttgagatggagtttcgctcttgttgccccaactggagaccaatgacatgatctcagctcactgcaacctccgcctcccgggttcaactgattctcctccctcagcctccggaaaagctgggattacaagcatctaccatcatacctggctaattctgtatttttagtagagaaggggtttctctatgttggtcaggctggtctccacctcccgacctcaggtgatctgcctgccttggcctcccaaagtgctgagattacaggcttgagccactgtgcccggccaaatttttattatttttaaattagaggtggggtctcaccatgttgaccagtttggtctcgaacttctggcctcagtcccttgtcttggcctcccaaagtgttggggtttcaggtgttagaccccatgcccaaccactacagtttttgtttttgtttttgtttttttttcagacggagtcttgctctgtcgcccaggctggagtgcagtggcgcaatcttggctcacggcaagctccacctcccgggttcacgccattctcctgcctcagcctccccagtagctgggactaaaggtgcccgccaccatgcccggctaatttttttgtatttttagtagagacagggcttcaccatgttagccaggctggtctcaaactcctgacctcagttcatccacccgccttggccttccaaagtgctgggattacaggcatgatccactgcgcccggcctcactgccattttatagatgagaaagccaagttccagaaaagttgtgaaatagacggtgactataaaactgggactagagatagtatcctaatgcttgttgattgtttttgtccatactgattgtcaacctaccaatataatctaccatcaagtca

SEQ ID NO: 182475 - DNA, 490 bp, Homo sapiens
  Payload ID: 15950
  Gene Symbol: SUMO2
  Gene Name: small ubiquitin-like modifier 2
  ENST ID: ENST00000578238
  CDS Start-End: 291-449
gggcagaaagcggacgcccgcggacccaccagccccgaacggggattcttggcccagccggccggcgcgcgtgaggaggggcgttagggcgcgcggggtctccaccttctgtcgaccccgcgtcgggtgttgcagtctccgaggcggcgaggagtcctctgggctcgggcttcacctctcgggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaa

SEQ ID NO: 182476 - DNA, 1807 bp, Homo sapiens
  Payload ID: 15951
  Gene Symbol: SUMO3
  Gene Name: small ubiquitin-like modifier 3
  Uniprot ID: P55854
  ENST ID: ENST00000332859
  CDS Start-End: 162-473
agccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 182477 - DNA, 520 bp, Homo sapiens
  Payload ID: 15951
  Gene Symbol: SUMO3
  Gene Name: small ubiquitin-like modifier 3
  ENST ID: ENST00000397893
  CDS Start-End: 1-444
atgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagggcatcatactgtcatggaaagagctttggacctggaaacagacttttttttttgagacggagtctcgctttgttgcccaggctagaatgcagtggcgcagtctcagctcactgtgcaagctctgcctcctgagttcacgccattctcctgcctcagcctcccaagtagctgggactataggtgcccaccaccactcccggctaatttttttgtatttttagtagagacggggtttcaccatgttagccaggatggtctcgatctcctgaccttgtgatctgcccacctcagcccccc

SEQ ID NO: 182478 - DNA, 1779 bp, Homo sapiens
  Payload ID: 15951
  Gene Symbol: SUMO3
  Gene Name: small ubiquitin-like modifier 3
  ENST ID: ENST00000397898
  CDS Start-End: 84-491
gggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacaggtacggagctggcttcgcgtggttccagggcgacttccgatttgtgcgggctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 182479 - DNA, 1921 bp, Homo sapiens
  Payload ID: 15951
  Gene Symbol: SUMO3
  Gene Name: small ubiquitin-like modifier 3
  Uniprot ID: P55854
  ENST ID: ENST00000411651
  CDS Start-End: 162-587
agccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 182480 - DNA, 1066 bp, Homo sapiens
  Payload ID: 15952
  Gene Symbol: SUMO4
  Gene Name: small ubiquitin-like modifier 4
  Uniprot ID: Q6EEV6
  ENST ID: ENST00000326669
  CDS Start-End: 166-453
ctggcgcacacagcgggaggggagggagcccaggatgtgcacgcaccctctccctcatccaccgctgtcacctcctgctgctcttcctgctgctcgtgtactcgttaggtgcggacccgccacctcttttgtgaagcagcagctgaggagactccggtgttcaccatggccaacgaaaagcccacagaagaagtcaagactgagaacaacaatcatattaatttgaaggtggcgggacaggatggttctgtggtgcagtttaagattaagaggcagacaccacttagtaaactaatgaaagcctattgtgaaccacggggattgtcagtgaagcagatcagattccgatttggtgggcaaccaatcagtggaacagacaaacctgcacagttggaaatggaagatgaagatacaattgatgtgtttcaacagcctacgggaggtgtctactgaaaagggaacctgcttctttactccagaacgctgttctttaaagaccaagattactgcattctcaattagaaaactgcaatttggttccaccacattctgactactacagtatagttttctctattcttttgtttcccccttccacattcttttattatacatgaagtaactggtatgtgtacacaagcatattgcttttttcttcaaaccaaacagccaatggtatgttttgattgacatcaagtggagacaggatgggaaaaaatactgattctgtgaaaataccccctttatccattagtggcatgttcattcaggtcttatctttatattctagtaagttattttgctctcactgttttaacaacaacaaaaaaaaattctcacataccttgttcaattggaggattttcatgtttttcatttatcattgtaaaaccaaggacaattttataacttttgtgtacatagctgttacatgtagggcaatctgtctttaagtagggataaattactctaaaaaaaaaagaaagaatcctagaaagtttttccttcaagtcaggcttcttatttaaataaactttttgtttaaaatgaaataaaaataaaaaca

SEQ ID NO: 182481 - DNA, 658 bp, Homo sapiens
  Payload ID: 15953
  Gene Symbol: SVBP
  Gene Name: small vasohibin binding protein
  Uniprot ID: Q8N300
  ENST ID: ENST00000372521
  CDS Start-End: 100-300
ctcccggaggcgttgtctgcgactcggcggaggctccaacttccagtggcccggtcgggaaagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggtttttttaaaaaaaaaaaaaaaacacacacaaaaaacactttttctattgtttgagaaaaatcagtgtttctcatgaaactctatatcttctccaaaaatacaaataaaatactaataaaa

SEQ ID NO: 182482 - DNA, 650 bp, Homo sapiens
  Payload ID: 15953
  Gene Symbol: SVBP
  Gene Name: small vasohibin binding protein
  Uniprot ID: Q8N300
  ENST ID: ENST00000372522
  CDS Start-End: 88-288
aaaactaaggctcaaagtggggaggagacttgcccagggacacccagcgagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggtttttttaaaaaaaaaaaaaaaacacacacaaaaaacactttttctattgtttgagaaaaatcagtgtttctcatgaaactctatatcttctccaaaaatacaaataaaatactaataaaatgtt

SEQ ID NO: 182483 - DNA, 4541 bp, Homo sapiens
  Payload ID: 15954
  Gene Symbol: SVIP
  Gene Name: small VCP/p97-interacting protein
  Uniprot ID: Q8NHG7
  ENST ID: ENST00000354193
  CDS Start-End: 118-351
agtggagggcggtgggggcggggcaagcgcggaggaccagggaccggctccggaccgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactacttatatttgtgctgcatcgcgttacatctgtttttatttcactatgaagatgtttgattaaacttatggacttagtgcctttaaactgatcatcagggagaatcttgaaaaaatcatttgaagggctgatgtgaaggagcactgtaaatttttataacttagtaatgagtattcttaggcagatgtaaaattttttccaatttatttttatttatgtagcttataaaattaacataccctgttttactttatgataaaggattttttgtttgctgaatttaaaattatatattagtgataccatcagagggcagtgatgttctattgtatattaaattcagctctgtaaggatctttgtagtaattgaatgagttaaactaataatctggatgggttataatgagtagtaatatatttgtccatatttcataagtagtgttaatcttgtgtacttattagagaacgatcataagatttatacagatgtgaaactgcgaaggcaagtatgaatgtatgaaaaaaacatgtaggtactgtacttacaaaaggtctacttcagatataaaaatattaggtaattctatacaatgcatagtcataaaccttaacatttttgttcattagaaacatgaattttatagcattttttgtttctcctatataatacactgaaataaaagaatttgtgttagctattaaggctgatagctcttttaaatggcaaggccacatgttgagccctaaattaaaatttgcagatattaagtgctaatagaaattttaagttaaatcgaccaagttcacttgctttacacaaaggaaactgagccactatcttcatctacccctccaacaaaaattatgttatactgcagtgtattgtacatgttaatttttaaaagtttgaactattatataatacaggtctcttgacttctcatggaaaaattattttttctattatggtgtgaaatattgtgtgaatatctaggcaaaacataacaatttggctcaattttcttctttagaggattcgtgctgtttttgttcataaagggtagtgaaatcattgaactatattttagaatgaaaatttttgattttattaaaatgattttttcaaggcagaaagtaaaaggaatgattgatagcggagtgcatatagagctagagcatatcatccttgaactctgcaaatcctttcttccattttaatatagcaagaacaattttgtctttactacatcttaaagaattagaacttgggttggtgtaagtgacttacttccagggaatcatgccctatttctaccagcaggtcatacccaaatgtcacactatctattgttaaccatgaatgatattcagatctattacttttcgtgaaaagtggaacatgttacttccaaccatggcctgtcaccgtgagtgtgatcagctttctccaaaaccacatgggtcgcaggagctaaggggtggtacccaaatgttaggaacagtgttaggaaagggcaagggaaaagaagtgactggatgtcttatgagaaaccggtaaatgactaaaaaaaaaagcaaatgactaaaaacatgactaaaaaattatatatatatataatatatatattatatatgtgtgtatatatatacacataatatctgcaaattctaatttatatatgtgtgtgtatatacacacacacacatgcacatacacacatacgtccagacatctccctcataaaataaccatcagtttctatgaaaaccttaagtggaagccaatttcccatagtaaataatttaggagaaaattataatgcttaaaatgttgctcaaacccctgacctattactaaactataattggaacagtaaaatgcatatatgtaactatcatatcatgatttaaaattgcttaaaccattgctgcttaatactaatcaaacttaacggctgctaacaaaagttgtgaattattacacggcctctttgtaacgtgctgcatgttttttaaaacatctctgtgtttctgtttgttccactgctggtatttggaatgtaatttaacagttctcacacatggtttggttataaattctgtattgccttttagggatataaatatacatttttttctatgtaaaaattagctttagctgtctctttaacaaaattttatctttactacatcctaaatacttagaacctgagttggtggttagggaaacctcaggaacattttaatcacattgggattcagaagagcaacagaaccaaaggttgtttggtgtgttcatacaatccctggatttataggtggattttctataaaggaaaaatgatgtaattagtatcctgttttttcctaaagaaataatactatcataaaaattctgtctatcctttgtaccccaggaaaatggacatgaactttgaattttccctttctccaaatgtttgactttttattttcactgataagcattatgctatgttcttagaagacaaaagcagctcttgccagttttgaataatttctgcatgaatagaccagtaagaggtaagtagccatgactgcctatatgtgttgagacataaggtatatttctttaacatctccaagcaagcatttcaaattctcttaactactaaacatgctctaagctaattcaaatatagtattgtggcttttttcttcaattttctcaaaagctacagacacaaggcatttgtatgtataacagactttgatgaagttttggttccagtaactcaaaacactaagtttcccatttgatatggctttttattgttctagtctccctcttctagttatgcttcatcttgcaaatattgactttgaatgtgataactattgcctacaaattaagtattcatacattactcctgtggatatcatacttttttgttattatatcctgaattgcattggctttttttggttttgttttgttttttgagatggagtttcactcttgttgcccaggttggagtgcaatggcacaatctcagctcaccgcaacctctgcctcccaggttcaagtgattctcctgcctcagcctccctagtagctgggattgcaggcatgtgccaccacgcctgactaattttgtgtttttagtagagacagggtttctccacgttggtcaggctggtctcgaactcctgacctcaggtgatccctgccgccttggcctcccaaagtgctgggattacaggcatgagccaccgcgcccggcctgcattggctatatttataataccaaatttgtgttgagttttgagttaatgtcttctagttatcaaaacaggtttgatccattctttgcaagtacctctaacttatctcaagtggaactaattagttttgcacacagattggtgctctctaggctatttccctgaaatttatcttgttacataagtcagatatcaaggagttatgctaaactccttttcctatcaaactcctaaaatgcccttttctctgtctatatttcttagacatagttacattataaatgtaacagatatatttaaagtaggttaataccaagtgtctcaggtagaaaattctcagaggttccacaaaaacttctggaactaataaatgactttagtaatcttgcagaatgaaaagtatatgaaagtcaattctatgtttatatgcaagcaatgaaaaatctgtaattgaaagtgggaaaatttaaattacaatatcaacaaataaaatatttaggaaaaataaaactgtagacattaaaaatgacaaaacattgccaataaattaagatctaaatg

SEQ ID NO: 182484 - DNA, 5905 bp, Homo sapiens
  Payload ID: 15955
  Gene Symbol: SLF1
  Gene Name: SMC5-SMC6 complex localization factor 1
  Uniprot ID: Q9BQI6
  ENST ID: ENST00000265140
  CDS Start-End: 420-3596
gctgcactgggtgtcaagcgccacggggtttgatggggactccttctggttccaccctcgcccactcacttctcgggctggccataatgctgcacagagccccggccagccattaatatcaggcgcaggagaaaacccagtaaaatcacttaccagtcttccacctccggtgctgatctagcaagagcctgacccgctggccagactcaagctctgcaccaggtattaccaccctggcgacggctccggagcgtcactgacaaccacccggaaatggtactatcgcttccggggctgcctagcgcgcggcgggaaattgtttcccagagcccggattcgtgaagcagttgagtgctgcagcggcagtcgtcgcccctgccgccgctgccaccgaaggaagcatcccagacaccgggaagatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcctccttgttagaactgataagcgaagtgattctcttataagagttttggaggctggaaaggcaaatgttattttaccaaaaagttcaccaagtggaataactcatgtgattgccagtaatgcaagaattaaagctgagaaagaaaaagataactttaaggctccattttatccaattcagtatctaggggattttcttttagagaaagaaattcagaatgatgaagattcccaaaccaattctgtttggactgaacatagcaatgaagaaacaaacaaagatttcaggaaagatgcaggatttcttgaaatgaaaggtgccttaagagagaccatgtatagaacccagaaagaaatgcaaaatcatgaagatgttaatgttggttctattttgattcaacatcacaaaaaagaaaaattcagtggttccagtaaagatttgaaatttgttaaaatgagaaatacctttggaagccatacatatgaaaatcagaaggaaattaagaaaaaagatgaagatattcagaggagttatactttgaggagaaaacgcaagaaaggaaaagaaagcaattgcaagaaaggcgttgaacatgaaaaaataaaaagtaccttaagaaggcacatatataatagagatcagaaagaaatgaagaattctatttttgctgaatatgccaaagaatcaaaagccatggctattaagacagatgtggatgttgttgaaataaaaaataccttaaggaagcacatatatagagctcaggctgtcagatacaactgcattagaatagataaacaaccagtgtacaacgtagaggttaaaaatgctgaatttcccagaggtgtattaaatttaattgaaagcctcatagaaggacatttttttaaagaagcaattgaggaactttccactttgcaggcacattatatccctcctgtatgcgttcttcatgcccttctagagaacgttctacaggataacatagatacattttctggtcgatactttcatatattgtcagctcttcttcacctgcatcctccttggaagtctccagccatgtcgagatattatttagagttgtttcagtgtccaacttgtatgaaaggagcatggtctttagtagaagtccttatcaggtcttgccttttcaatgaaagcttttgtcatcaaatttcagaaaatattggctccaaggtgctccacctgacgctactcaaatttttctttaatttaattgaaagtgaagtacaacatctgagtcaaaagttgtatgactggtcagattctcagaatctgaaaataacaggaaaggcaatgcttcttgaaattttttggtcaggaagtgaaacctctgggcttttgaccaaaccagtaaatatgcttttggaatggactatatattctcacaaggaaaaattcaagtctaatgatgtcttcaaacatgaactagcttacttattggctggaattcttggagcagcaatagattattggattttccttggtcttaagatgggtagaaatgtgatgcgacacatgtctgatgacttaggaagttatgtttctctttcgtgtgatgacttttcttcacaggaattagagattttcatttgctccttttcctcctcctggcttcaaatgtttgttgcagaggcagtctttaaaaagttgtgtctacagagctctggcagtgtttcttctgagccactctctcttcagaaaatggtatattcctatttaccagccttggggaaaactggtgtgcttgggtctggaaagattcaggtgtcaaagaaaataggacagcggccttgttttgactctcagagaaccttactaatgctgaatggtactaaacaaaaacaagtcgaagggctgccagagttactagacctgaaccttgctaaatgttcctcatcattaaaaaaattgaaaaagaagtcagaaggagaattgtcatgttccaaggagaattgcccctctgtagttaaaaagatgaattttcacaagactaatctaaaaggagaaacagccctgcatagagcttgcataaataaccaagtggagaaattgattcttcttctctctttgccaggaatagacatcaatgttaaagacaatgctggctggacgcctttgcatgaagcctgtaactatggcaacacagtgtgtgtccaggaaattttgcaacgttgtccagaggtagatctgctcactcaagtggacggggtgactcctttgcatgatgcactgtcaaacggacatgtagaaattggcaagctgctactacagcatgggggcccagtgcttttacaacagaggaatgctaagggagaattgcccttggattatgtggtttcacctcaaatcaaagaagaactgtttgctattacaaaaatagaagatacagtggagaactttcatgcacaagcagagaaacattttcattaccagcaacttgaatttggctcctttttacttagtaggatgttgctaaatttttgttcaatttttgatttatcttcagagttcattttagcttccaaagggttaactcatctaaatgaactgcttatggcttgtaaaagtcataaagaaaccaccagtgttcatactgactggttactggatctttatgctggaaatataaagacattgcagaaactcccacacattcttaaggaactgcctgagaatttgaaagtgtgtcctggggtacacactgaggccttgatgataacattggaaatgatgtgtcggtcagtcatggagttttcatgatgatgctagaaagtatggattgactttctaaatctgttcagtttgcattggtacttactgtggacttcatagcttactgacagatagtaatttgatttatttattgacagactttgcagccttgctaaattttaaaagcatttttaaaaaaacttctacaaaactctagtatgggcttctgactttttccagggtgtagaatttgactcaaaagtaaaaataattttgttttagtatattctactttcattaatgtttttttgttctgaaagtgatattatattgtacatgtaaaattaatttaaatattttttcaaataaaaatgtaatgtcctgtattctagatgttctaggtcttagaatcatggcaagcatattcatacaaatgcgtacctataaacttgtagctcctgactcttagggatggattttgaggaaaaaacaagactaaacaaaaacatgtagctccctatttcttctctctaggttgttggactgaaatatgcattttagctttgtgtgtttctaaaataaacatttctaaaatttacagtaataattaatattcttttggtttttaaatgcagcaaatatgcagagtctgacagttcaattccttgatctgttttattttagcaattcatatacaaaatgtatctgtcgctgccctatgtaacccagtattctgtacctgaaaacattctgctgcataggtttatgagtttaatattaagatattgagtggcatctaagtaatagatttgagattatttaagatcttaatatatagtatgaatttactgagtagtaatgttttaatttgcagtttttccttatagcagtttgtagtaaaactaaaagaaagggtgtggataataaccacttttgagattggagtttcttcactactgggagtaagttacattatgatacaggtggaaaataaacacttccatttagcttttatgtaattcaagtgatgaccttagcagttaatctgctaaagcaatacacttcagttttattttggaaatagatattttaacaagatacaaatgctcagtatcatattactgggtttgtaatctaaattgaaaactgctatatcagtatgaaaaaatattttaaataagtactttttccacacatactcaggaaatactagtttctatttagccttcaaatttggcatcatacaaatctctttattattaatctgccaaagtatcagacaaaaaatgatatagtgaagactatctaagaagagtttaaatgcttatagagagtaaagtgcttctccagatgatgaataagaacgttttttattccaatgagtacctctttacttcacttgtaaaggtgtctgggatagtgtttgcttggtaaactaatataaacttgtaaacataggctttgacatcatacacattttcaaatccttgtctagtttcttaataactaaattgcaaggcaaattcttttctgagctttggctttcctacatgtcaaatagaaatcacaccaggtatctttgtcatgatagaattgttagcatatcacatcatatgacacttaataaatattatttcctttctaattcttacctcctcttttgattataatgaatcatttagacaaaaggcaatatagtaattgtttaagttggtagtaattctaaggtaattaaggaatcaacatcatgagttagggttttatactgttagtacaaagtagttttccaaattagatgttcataacgtatatttgtttaattgcaattagcattaatatttcataattgactgctctgtctgccaacttctacaagcagtgatgacatgaagtgtgaaacagatgtcactgaggtctctgcctttaagaagttttacacttcttcgaaagtccaacgtggcaaacataggttactgtgttctgtgccctggctaacaataccagtatatgagtatgaatctaaatgttcaggaaaaggcttcattcccaaaattacttcttatactttattttagaaaacataataataattgccttgaataattgcccaaatctatcttggaggtataggaagaagaaattctcaataagtaaagtataattcatagtcttagtcctagattttcaatggcagacttttcaaagttgcatctgaagacaaggttgagaaatgctattcttcactgtattttgccagatgtgatatcatagttctatggaatcatattttttaaatttctgtaagagaccttattacaatgtaaataaagctggagaggagatttctgagcagttaa

SEQ ID NO: 182485 - DNA, 1079 bp, Homo sapiens
  Payload ID: 15955
  Gene Symbol: SLF1
  Gene Name: SMC5-SMC6 complex localization factor 1
  Uniprot ID: Q9BQI6
  ENST ID: ENST00000508130
  CDS Start-End: 89-628
cggattcgtgaagcagttgagtgctgcagcggcagtcgtcgcccctgccgccgctgccaccgaaggaagcatcccagacaccgggaagatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcctccttgttagaactgataagcgaagtgattctcttataagaaagaaattcagaatgatgaagattcccaaaccaattctgtttggactgaacatagcaatgaagaaacaaacaaagatttcaggaaagatgcaggatttcttgaaatgaaaggtgccttaagagagaccatgtatagaacccagaaagaaatgcaaaatcatgaagatgttaatgttggttctattttgattcaacatcacaaaaaagaaaaattcagtggttccagtaaagatttgaaatttgttaaaatgagaaatacctttggaagccatacatatgaaaatcagaaggaaattaagaaaaaagatgaagatattcagaggagttatactttgaggagaaaacgcaagaaaggaaaagaaagcaattgcaagaaaggcgttgaacatgaaaaaataaaaagtaccttaagaaggcacatatataatagagatcagaaagaaatgaagaattctatttttgctgaatatgccaaagaatcaaaagccatggctattaagacagatgtggatgttgttgaaataaaaaataccttaaggaagcacatatatagagctca

SEQ ID NO: 182486 - DNA, 578 bp, Homo sapiens
  Payload ID: 15955
  Gene Symbol: SLF1
  Gene Name: SMC5-SMC6 complex localization factor 1
  ENST ID: ENST00000504099
  CDS Start-End: 187-578
gaagcagttgagtgctgcagcggcagtcgtcgcccctgccgccgctgccaccgaaggaagcatcccagacaccgggaagagacagggtttcaccatgctgtccaggctggtctcgaactcctgatctcaagtgttccgctcgcctcggcctcccaaagtgctgggattacaggcgtgagccaccggatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcct

SEQ ID NO: 182487 - DNA, 593 bp, Homo sapiens
  Payload ID: 15955
  Gene Symbol: SLF1
  Gene Name: SMC5-SMC6 complex localization factor 1
  ENST ID: ENST00000466957
  CDS Start-End: 1-388
caaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcctccttgttagaactgataagcgaagtgattctcttataaggctgtcagatacaactgcattagaatagataaacaaccagtgtacaacgtagaggttaaaaatgctgaatttcccagaggtgtattaaatttaattgaaagcctcatagaaggacatttttttaaagaagcaattgaggaactttccactttgcaggcacattatatccctcctgtatgcgttcttcatgcccttctagagaacgttctacagctcttcttcacctgcatcct

SEQ ID NO: 182488 - DNA, 7288 bp, Homo sapiens
  Payload ID: 15956
  Gene Symbol: SLF2
  Gene Name: SMC5-SMC6 complex localization factor 2
  Uniprot ID: Q8IX21
  ENST ID: ENST00000238961
  CDS Start-End: 543-4064
caattgtgtgacacaggaagcccaagtgttggccatcctcaacgaaggcagctgccgggctccggtttgcttcagcaaaccctcacccctcgccttcaaccaggcgggtgtcgtcagctgtccgccagctgctgcccgcgcctttccgcccccgcgcgccggccaaggccgaggcggccgggaccagaggcgcgcgccctcagtgcatgtgacggggtgggagggggaggtttcttcctcccccgtccccaagccccgccttctccagagaggctgcggcttcctattgcgccaccaccgaaatgaccaccgtgccagccaatcaagacgtgattcatgaagtaagacccgccccttactggtccccaggttccttcccgctcacgccggagtcacttccgaagagagaaccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctgttttgatgccagaacattcatatgctgtttgttctggatttcttttaaatgcatgtattttaaatactggttaaatcttagaatcttggctatatcttagaattctggctcttggtaaccatattacagaagtctatattgtaaaagcctaaagatctggacaagtttccaacaaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagctgctgtaaattcttaaacactggagagccatcctttggtttaaatggtagagggttagtggaagtgcacacgttgtttttagcccaggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaaca

SEQ ID NO: 182489 - DNA, 3712 bp, Homo sapiens
  Payload ID: 15956
  Gene Symbol: SLF2
  Gene Name: SMC5-SMC6 complex localization factor 2
  Uniprot ID: Q8IX21
  ENST ID: ENST00000370269
  CDS Start-End: 133-3693
ccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaaggctagatgaactgcagaagcaactacaagaagacataaggcaaggccgaggcattaaatccccaatcagaattggagaagaagacagtacagatgatgaggatggcctcttagaagagcacaaggaatttctaaagaaattttcagttacaattgatgctattcctgatcatcatccaggtgaagaaatatttaatttcctcaattctggaaaaattttcaatcagtataccttggatttaagagactctggttttattggacaaagtgctgtagaaaaacttattcttaaatcgggaaaaacagatcagatttttttgacaacacaaggtttccttacgtctgcttatcactatgtccagtgtcctgtccctgtgttaaagtggctgtttcggatgatgtcagttcatacagactgtattgtgtcagtgcagattttaagtacattgatggaaataacaattagaaatgataccttcagtgactcaccagtttggccatggatcccatcattgtctgatgtagcagctgtgtttttcaatatggggattgattttagatctttgtttcccctggagaatcttcagccagactttaatgaagactatctagtttctgaaacacagacaacatcaagggggaaagaaagtgaagattcatcttataagccaattttttcaacacttcctgaaaccaacattttaaatgtggttaagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtgcctgaactctgtctgggcataaatgaactctccagtcatccccacaacctcctgtggttggtacagctggtccctaattggacatcacgtggaaggcaactgagacagtgcctcagtctagtgattatttcaaagcttttggatgagaaacacgaagatgttcctaatgccagtaatctgcaggtatcagtcctacatcgctatcttgtgcagatgaagccttctgatttgttaaagaaaatggtcttgaagaaaaaggctgaacaaccagatggcattattgatgacagtcttcatttagaacttgaaaagcaggcatattacctgacctacattcttcttcatttagtcggtgaagttagttgttctcattctttttcttctggacaacggaaacactttgtgctactctgtggggctttggaaaagcatgttaaatgtgatattagggaagatgcaagacttttttacagaactaaggtgaaagacttggtcgccaggatacatggaaaatggcaggaaataatccagaactgtcggcctactcaggtgtcattttgttatacaatttcatgtattcttaatagttttgctgaatggcactcttcatactgtttgaaataaaatagggtataacagtgca

SEQ ID NO: 182490 - DNA, 2931 bp, Homo sapiens
  Payload ID: 15956
  Gene Symbol: SLF2
  Gene Name: SMC5-SMC6 complex localization factor 2
  ENST ID: ENST00000370271
  CDS Start-End: 149-2425
acttccgaagagagaaccgccatgaagagagaagggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggaaaatggacatctctcaagaaaaagatcctcttctgattcatgggaacctacttcagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacaggacatgttcatcctggaacttacacaaataccttagaacgtctagtgaaggaaatggaagacacacaaaggtttgttagcataaagattaatttgctaaatttaacattttgcttgtttgtgtggcttacttttaatttaccttttttaaaaaatcatgagaaattagcgtgcattttggactctgttgtcaactgtgttagaataagatatgttggccggacgcagtggctcatgcctgtaatcacaacactttgggagacccaggcaagattacttgagcccaggagttcaaggctgcggtgagtcgtgatggcgccacttcactgcagcctgggtggcagagtgagacccagtctcaaatgaaaaaaagaggccaggtgtgatggctcatgcctgtaatccagtactttaggaggccaaagcaggcaaatctcttgagcccaggagtttgagactagcctgggcaacatggtgaaaccccatctctacaaaaaatacaaaaattagccagtcatggtgccacatacctatggtcccagctactcaacaggctgaggttgggaggatcacctgagcccaaggaggtcaaggctgtagtgagctgtgattgagccactgcactccaatctgggtgacagaataagaccccgtctcaaaaaaaaaaaaagtggggggccaggcgcagtggctcacgcctgtaatcccagcactttgggaggccgaggcaggtggatcatgaggtcaggagatcgagaccatgctggctaacatggtgaaaccccatctctactaaaaaataaaaaaaaaaa

SEQ ID NO: 182491 - DNA, 891 bp, Homo sapiens
  Payload ID: 15956
  Gene Symbol: SLF2
  Gene Name: SMC5-SMC6 complex localization factor 2
  Uniprot ID: Q8IX21
  ENST ID: ENST00000609386
  CDS Start-End: 116-307
gggggtgccgcccacctctgctccgacagcctcccggagtcccagcagcaagacggcaaccacgcacccaacttctccagccacggctcatgccgccgtcgccagcggcgccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggtaccgtgcagagggcttgagaaggggccgggtcgcgggggcaagggtatgaggggagggctgcagaccgccgctcttccagttcccgccatcctccgcgagctcaggcgttggcatttcggggcctggcaaatccccgccccgcctccgcgcaggggctactgggagttggagtttgcttctctgtagttgggcagctgctcttggtctagtgaccaccagcctggacagctacggagaacccgccttaggtagaaagaaagtgatttttttcctttgcaagagtttgacccgggaccctaactgcttaatgcatatttagatcgttttctgtacgttgtcagttctactgatcctagtggtttagtaatataaaccttttctatgttgtgggtgaaattatgtaacctgtgatgagggaatcccttccacgaattactttgtagtccagcgtgcacgctagttcatacttaaaagaacttgcagatttggaatgtgacgtgttttctctttcagtaacttcacgcctctccaagaggctaatttttttgtaaagattttgtgggagctatgtaatgagatggggagtttcatctaatgacatcctctgacaataaaacatgtttaaattcccta

SEQ ID NO: 182492 - DNA, 16115 bp, Homo sapiens
  Payload ID: 15957
  Gene Symbol: SMG1
  Gene Name: SMG1 phosphatidylinositol 3-kinase-related kinase
  Uniprot ID: Q96Q15
  ENST ID: ENST00000446231
  CDS Start-End: 414-11399
gtgcgacagcggcggcgcggcgggcggagccgggaggcggggaagcagtggccgtgtgagcgtgaggagctgccgccaccgcctgctcctcgtcgtcctcgtcctccggggccccggcgacgtgggccgcgcacggccctggaaaagacgtcgcctccccttcatccgcctctctctcaccgcgccgctcccgcctcctcgtcctgcgctgcgggctcaggcggaacccggaacggccgtcctcttcccccgccctccgccgcctcctccttctcctcctcctcctcctcctcctccttctcggcttcctcctcagccccgggccggagcggggtgtcggcggcggccggttcgggcggcgactcgcgcttctttgggcggcggcgcttggccatgtcgtgtcggggaaggtaatgagccgcagagccccggggtctcggctgagcagcggcggcggcggcggcggcaccaagtatccgcggagctggaatgactggcaacccagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaagacatggaagcatatgctgaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcatgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcaacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagca

SEQ ID NO: 182493 - DNA, 1259 bp, Homo sapiens
  Payload ID: 15957
  Gene Symbol: SMG1
  Gene Name: SMG1 phosphatidylinositol 3-kinase-related kinase
  ENST ID: ENST00000532700
  CDS Start-End: 254-1259
cttctcggcttcctcctcagccccgggccggagcggggtgtcggcggcggccggttcgggcggcgactcgcgcttctttgggcggcggcgcttggccatgtcgtgtcggggaaggtaatgagccgcagagccccggggtctcggctgagcagcggcggcggcggcggcggcaccaagtatccgcggagctggaatgactggcaacccagattgacttgatgcaaaacatcacaaaggctccatattatacagtatgcgatttttgagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttg

SEQ ID NO: 182494 - DNA, 562 bp, Homo sapiens
  Payload ID: 15957
  Gene Symbol: SMG1
  Gene Name: SMG1 phosphatidylinositol 3-kinase-related kinase
  ENST ID: ENST00000569122
  CDS Start-End: 377-562
tgttcagcccggggctggagccgagacccggggctcccggcggtggcactggcctggggtcgggaccaggagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggct

SEQ ID NO: 182495 - DNA, 2910 bp, Homo sapiens
  Payload ID: 15957
  Gene Symbol: SMG1
  Gene Name: SMG1 phosphatidylinositol 3-kinase-related kinase
  ENST ID: ENST00000563235
  CDS Start-End: 1-2561
gagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaaggtaagtggtttttttttcttgtaagagaaaattaaaggtgttctttttttaaattttgctttattgaggtttatattacacattctaagtgtatggtttgatgagttctaacatgtcttcacttgtgtgaccaccaatacgatcgagatacagaacaccgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcaacatgatatttttaaggttcacccatattgcatgtatcaggaatacaatcctttttattattga

SEQ ID NO: 182496 - DNA, 565 bp, Homo sapiens
  Payload ID: 15957
  Gene Symbol: SMG1
  Gene Name: SMG1 phosphatidylinositol 3-kinase-related kinase
  ENST ID: ENST00000563836
  CDS Start-End: 396-565
aatgggaagacaaagatcttttgtattggcactaccagctgtgtccctctgagggggtaatttttgccttttgaagacgttgggagggttaaagttcaggaaattatttttaaaactgtttcagtgaatatttagaaaaatattagtggagatagaattaattgctccgcagtggagtggctctctttctacattttctttttttttgagacgagtctcgctctgtcccccaggctggagtgcaatggtgcgatctcagctcactgcaacctccgccacccgggttcaagcgattatcctgcctcagcctcctgagtagataggattacaggcatgtgccaccacacccagattgacttgatgcaaaacatcacaaaggctccatattatacagtatgcgatttttgagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatga

SEQ ID NO: 182497 - DNA, 12465 bp, Homo sapiens
  Payload ID: 15957
  Gene Symbol: SMG1
  Gene Name: SMG1 phosphatidylinositol 3-kinase-related kinase
  ENST ID: ENST00000565324
  CDS Start-End: 1-10656
caaccttcaaattcagctgtggtgtctcggcaaaggcacgatgataccagagtccacgctgacatacagaatgacgaaaaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaagacatggaagcatatgctgaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcatgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcaacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagat

SEQ ID NO: 182498 - DNA, 2372 bp, Homo sapiens
  Payload ID: 15957
  Gene Symbol: SMG1
  Gene Name: SMG1 phosphatidylinositol 3-kinase-related kinase
  ENST ID: ENST00000565224
  CDS Start-End: 45-1868
attgacttgatgcaaaacatcacaaaggctccatattatacagtatgcgatttttgagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaagacatggaagcatatgctgaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtgtttcttacagctcaaatttgtgtagttgttttaaaatgcggtctctttcttcttcccctggtacttttttctttctgtctactgaagttagttcttatacatggtcttatattttggctgtctcttttccctaggaacattcatacaggttgaatattccttatctgaaatacttgggactggaagtgttttggattttggattttggaatac

SEQ ID NO: 182499 - DNA, 1210 bp, Homo sapiens
  Payload ID: 15957
  Gene Symbol: SMG1
  Gene Name: SMG1 phosphatidylinositol 3-kinase-related kinase
  ENST ID: ENST00000568038
  CDS Start-End: 1-964
tcacttccctgccattcagtatgctgtgctctacacattgtattctcattgtaccaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggaaactgttaatgacttgggctttggaagcagctgttttaatgaagaagtctgaaacatacgcacctttattctctcttccgtctttccataaattttgcaaaggccttttagccaacactctcgttgaagatgtgaatatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaaccattatgatggtggtagaagcattatgtgaacttcattgtcctgaagctatacagggaattgctgtctg

SEQ ID NO: 182500 - DNA, 2664 bp, Homo sapiens
  Payload ID: 15957
  Gene Symbol: SMG1
  Gene Name: SMG1 phosphatidylinositol 3-kinase-related kinase
  ENST ID: ENST00000561947
  CDS Start-End: 1-1654
aactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggatacagttgatatattagttggatggcatatagatcatactcagaaaccttcgctcacgcagcaggtatctgggtggttgcagagtttggagccattttgggtagctgatcttgcattttctactactcttcttggtcagtttctggaagacatggaagcatatgctgaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtgtttcttacagctcaaatttgtgtagttgttttaaaatgcggtctctttcttcttcccctggtacttttttctttctgtctactgaagttagttcttatacatggtcttatattttggctgtctcttttccctaggaacattcatacaggttgaatattccttatctgaaatacttgggactggaagtgttttggattttggattttggaatactttttttttttttttggagatggggttttactcttgttgcccaggctggagtgccatggcgcgatcttggctcgctgcaacctccgcctcccgggtacaagcgattctcctgtttcagcctcccaggtagctcggattacaggcatgcaccaccatgcctggctaatttttttgtatttagtagagatgggttttcaccatgttagccgggctggttgtgaactcctgacctcaggtgatccacctgccttggcctcccaaaatgctgggattacaggtgggcaccaccatgcccagccggattttggagtattttcataacacttactggtgagcatccctaatctgaaaatcctaaatctaaaatgctccaaaatttgaaactttttgagcaccagtatgatgccccaagtggaaaatcccacacctgatctcatgtgatgagtccaaactgttgtatgcacaaaattatttaaaatattgcataaaatgaccttcaggctatg

SEQ ID NO: 182501 - DNA, 1588 bp, Homo sapiens
  Payload ID: 15957
  Gene Symbol: SMG1
  Gene Name: SMG1 phosphatidylinositol 3-kinase-related kinase
  ENST ID: ENST00000330588
  CDS Start-End: 267-860
aacaaatgttttaacccactgtcttcactaatattgtaactactgtcttacagattgacttgatgcaaaacatcacaaaggctccatattatacaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaaggagagatcgatgtcttattctgatgagtctcgactgtcgaatcttcttcggaggatcacccgggaagacgacagagaccgaagattggctactgtaaagcagttgaaagaatttattcagcaaccagaaaataagctggtactagttaaacaattggataatatcttggctgctgtacatgacgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtctattcttgaaaatgtggatacaccagaattgctttgtaaatgtgttaagtgcattcttttggtggctcgatgttaccctcatattttcagcactaattttagggtgagttcctcattccgcttttcagatcatggggtgagggggatggttgtgtgtgtgaggatctgaggaaacagatggaaaacaatgcctcagctcctttgaatataatcagtgatatttgaggttccagggttaaataccgcatttttctttctgacattcataccttaaaatatttgaagaaaataaactatttcattgttgtcagaaatgtagttcttttattttcctgcccctctcccctttctaagtttctagaatgtcaagtaggtagaacatagatgctccttttaggatcttttgctgtgaaatggtccacaggtgaatggcagtaatatcttaaaatgattggccccctctctctttgtttccatcaaggatacagttgatatattagttggatggcatatagatcatactcagaaaccttcgctcacgcagcaggtatctggtaagtcttgcagcctataccagttatttaaatactgtcggggaggagcagtggtcccccagtgaccatctatcaataccatttctttaataatgcaagaaaactaattcagagaaatgttttattgtaaatgaacattacttgttagctaaatatgtattttcagaggaaattactagtaggtgggtacagtaagtacagacaggacttacccaagttatttgtagtttgtactggtaggaaagtgtatggtaagaatatattgtagtggcaataccctgaagtggacaatggaagatccaagttatttgtcacattttattgtttttctggtaattttttt

SEQ ID NO: 182502 - DNA, 550 bp, Homo sapiens
  Payload ID: 15957
  Gene Symbol: SMG1
  Gene Name: SMG1 phosphatidylinositol 3-kinase-related kinase
  ENST ID: ENST00000566328
  CDS Start-End: 1-257
cagagatgaaaacaaccagcctatctcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggagcattgaagcttgctataaatcacttcaccaggaggcgtcttcagtttgttctttagttagcagcaatacttgagtgcctttcttactgaagaattagtggcaaatcacactgtaaaacaagacctgtcagttattttataaatgcttttgaacttgatccctagttgagctccttccccctcagagtctgatacaaattaccctttattgtcagagtatttgctcattagtcctgtgaactctacattcagactcattgcttcctccaggtagaggagcttgtaccataatattctgtgtccatttatgttagtttaatgaaatcttgcgaatttaggaaaataaaagaactgctcatacttccat

SEQ ID NO: 182503 - DNA, 4559 bp, Homo sapiens
  Payload ID: 15958
  Gene Symbol: SMG5
  Gene Name: SMG5 nonsense mediated mRNA decay factor
  Uniprot ID: Q9UPR3
  ENST ID: ENST00000361813
  CDS Start-End: 146-3196
gtcgcgggcagccgcctcacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 182504 - DNA, 5960 bp, Homo sapiens
  Payload ID: 15959
  Gene Symbol: SMG6
  Gene Name: SMG6 nonsense mediated mRNA decay factor
  Uniprot ID: Q86US8
  ENST ID: ENST00000263073
  CDS Start-End: 52-4311
gctgcgcgcggcggtggcggagccgctacggctgtagcagcagccgcgaagatggcggaagggctggagcgtgtgcggatctccgcgtcggagctgcgcgggatcctggctactctggccccgcaggccgggagcagagaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggctgagatagaaaagagcccaggtggtgggagagtaggggctgcaaaaggagaaaaaggaaagaggatgggaaaaggggagggggtgagggaaacccacgacgacccagcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttctgagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctctctcctcactggcctttctttccgtctagcttcctcttcaggaaatgtcctgactcccctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacata

SEQ ID NO: 182505 - DNA, 3473 bp, Homo sapiens
  Payload ID: 15959
  Gene Symbol: SMG6
  Gene Name: SMG6 nonsense mediated mRNA decay factor
  Uniprot ID: Q86US8
  ENST ID: ENST00000354901
  CDS Start-End: 296-1831
ggacccagatacccgtcagaatttccaggccttggtttggtttagacattttagaagatgttaacagcaataattgtaaaagactttgagtggcacgcatggtgaacagaaagtactagatcctgaagaggggggaaaggcatttctgtgctcttcctggtaaagtgtttgaaaatgaacattcagaagaaaacctaaagcacctgaaatgcacaggggacgagaatgagagctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttctgagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctctctcctcactggcctttctttccgtctagcttcctcttcaggaaatgtcctgactcccctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatg

SEQ ID NO: 182506 - DNA, 1865 bp, Homo sapiens
  Payload ID: 15959
  Gene Symbol: SMG6
  Gene Name: SMG6 nonsense mediated mRNA decay factor
  Uniprot ID: Q86US8
  ENST ID: ENST00000536871
  CDS Start-End: 243-1778
ataccagagagtttagggactgtgaaggtttcaggaaatttgttgagtatttagaaaagccgatggtttcagagagaaactttgatattagcttgaacacagttattgccaggggtgaggaaatagcataccaaagcataataactcatagtgatttatccaaaacttgagttgtttgcatctctggaccctgaaaactcctttatcttgaatttgttcaaaattgcaggataccgggaaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcc

SEQ ID NO: 182507 - DNA, 574 bp, Homo sapiens
  Payload ID: 15959
  Gene Symbol: SMG6
  Gene Name: SMG6 nonsense mediated mRNA decay factor
  ENST ID: ENST00000575663
  CDS Start-End: 88-574
atacagaccccgatgagcagagccttgtgagagggaggaggacggcaacacacgaagaactgagacagatgactgggggcttctaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcag

SEQ ID NO: 182508 - DNA, 588 bp, Homo sapiens
  Payload ID: 15959
  Gene Symbol: SMG6
  Gene Name: SMG6 nonsense mediated mRNA decay factor
  ENST ID: ENST00000571442
  CDS Start-End: 95-588
aaacgcttgggtaaaatatctttaggccgagtgcagtggctcatgcctgtaatcccagcactttgggaggccgaggcaggtggatcacttgaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatca

SEQ ID NO: 182509 - DNA, 572 bp, Homo sapiens
  Payload ID: 15959
  Gene Symbol: SMG6
  Gene Name: SMG6 nonsense mediated mRNA decay factor
  ENST ID: ENST00000570606
  CDS Start-End: 204-572
aataattgtaaaagactttgagtggcacgcatggtgaacagaaagtactagatcctgaagaggggggaaaggcatttctgtgctcttcctggtaaagtgtttgaaaatgaacattcagaagaaaacctaaagcacctgaaatgcacaggggacgagaatgagaggtgattagaagcccaacacatgcaccagttcttaggtggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagat

SEQ ID NO: 182510 - DNA, 652 bp, Homo sapiens
  Payload ID: 15959
  Gene Symbol: SMG6
  Gene Name: SMG6 nonsense mediated mRNA decay factor
  ENST ID: ENST00000575454
  CDS Start-End: 29-652
aagcgtctcaggcacactgtctggaaagatgacaggaccctgcattaggcaactgagtctccaaattctttttcctctctgtgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaa

SEQ ID NO: 182511 - DNA, 547 bp, Homo sapiens
  Payload ID: 15959
  Gene Symbol: SMG6
  Gene Name: SMG6 nonsense mediated mRNA decay factor
  ENST ID: ENST00000570668
  CDS Start-End: 191-547
acaaggcagccactttagtcagtgacacacacagcccgaaaacgatggtatcttctgaggttttaaaggatagggacagagtcatctcggattcgggagaagtactcagtcggggtgccatatggctcctgacagaccctttcctggtgagaggcagatcacacctgcacttggactccactgagagaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaa

SEQ ID NO: 182512 - DNA, 592 bp, Homo sapiens
  Payload ID: 15959
  Gene Symbol: SMG6
  Gene Name: SMG6 nonsense mediated mRNA decay factor
  ENST ID: ENST00000570659
  CDS Start-End: 104-592
ttggctcagctgagcggcagctgttgggcatgtgccctggctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtg

SEQ ID NO: 182513 - DNA, 689 bp, Homo sapiens
  Payload ID: 15959
  Gene Symbol: SMG6
  Gene Name: SMG6 nonsense mediated mRNA decay factor
  ENST ID: ENST00000572369
  CDS Start-End: 274-689
ggggtaggtaggaagattgctgtttctttgctggtcagactctccaggctctctgcggagagtccaggcaggatctgtctgacttggattgcagttctctttttctgctgagctggggtgtgggcagcctaggcctgtgtaactcgtgacaggcctcccaaagtgccatgatggcatggatcctcgtggagctgttgagaacaaaaacaggactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaac

SEQ ID NO: 182514 - DNA, 557 bp, Homo sapiens
  Payload ID: 15959
  Gene Symbol: SMG6
  Gene Name: SMG6 nonsense mediated mRNA decay factor
  ENST ID: ENST00000575176
  CDS Start-End: 186-557
ctagttggttgagtcagaacctggagttagtttggtagggtgtggtttcaggtttgcagacatccccggttgatgcctatgaagggttggtgcctgatgtaactgaatagggtgctacttcagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtc

SEQ ID NO: 182515 - DNA, 551 bp, Homo sapiens
  Payload ID: 15959
  Gene Symbol: SMG6
  Gene Name: SMG6 nonsense mediated mRNA decay factor
  ENST ID: ENST00000572205
  CDS Start-End: 205-551
ttgatatcagaaaaaagaaaaagcttctctgggcagctagacagtgcaaggaatgtccccccaaatctgagcactgttgttctctgatgaagaaagtgacctgtgaatctgatctgagataggaagaggaacaggagtaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaaga

SEQ ID NO: 182516 - DNA, 5788 bp, Homo sapiens
  Payload ID: 15960
  Gene Symbol: SMG7
  Gene Name: SMG7 nonsense mediated mRNA decay factor
  Uniprot ID: Q92540
  ENST ID: ENST00000347615
  CDS Start-End: 120-3533
gagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctcc

SEQ ID NO: 182517 - DNA, 5970 bp, Homo sapiens
  Payload ID: 15960
  Gene Symbol: SMG7
  Gene Name: SMG7 nonsense mediated mRNA decay factor
  ENST ID: ENST00000367537
  CDS Start-End: 196-3708
cccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccaga

SEQ ID NO: 182518 - DNA, 2483 bp, Homo sapiens
  Payload ID: 15960
  Gene Symbol: SMG7
  Gene Name: SMG7 nonsense mediated mRNA decay factor
  ENST ID: ENST00000419169
  CDS Start-End: 214-2483
gagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctct

SEQ ID NO: 182519 - DNA, 580 bp, Homo sapiens
  Payload ID: 15960
  Gene Symbol: SMG7
  Gene Name: SMG7 nonsense mediated mRNA decay factor
  ENST ID: ENST00000444547
  CDS Start-End: 120-341
gagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctggggaccagtgtctgcccagtgagtcactgctataccaaatagaattacattttgttttcagctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacag

SEQ ID NO: 182520 - DNA, 1190 bp, Homo sapiens
  Payload ID: 15960
  Gene Symbol: SMG7
  Gene Name: SMG7 nonsense mediated mRNA decay factor
  ENST ID: ENST00000440812
  CDS Start-End: 406-960
gaagccgcacaggcgccacacagctcgttgatcccaaaagggagcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgtgccatataactcaccccttcttgtgggccggctccaggtcaccagcatagtccatagtgggagctggtgatgcatgacactggaggacctgaaaatggggtctagctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgc

SEQ ID NO: 182521 - DNA, 5629 bp, Homo sapiens
  Payload ID: 15960
  Gene Symbol: SMG7
  Gene Name: SMG7 nonsense mediated mRNA decay factor
  Uniprot ID: Q92540
  ENST ID: ENST00000515829
  CDS Start-End: 95-3370
cggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacc

SEQ ID NO: 182522 - DNA, 566 bp, Homo sapiens
  Payload ID: 15960
  Gene Symbol: SMG7
  Gene Name: SMG7 nonsense mediated mRNA decay factor
  ENST ID: ENST00000502375
  CDS Start-End: 398-566
gtttgctagcgaggggtggagagaaacgtccggggaggcggcggcgaccccgagtggaggagcagaactaagaaagggaggccttatggaaagatgttttttaaaaaattgtttcataccttgcggaggagggagttggatgaggtggaagtctgaaatgagtggaaaagtcactttagctgtttagtgacatgaaagtattgacgtgtgtggatccctatatgtatattgcaagaggattgctgggaggagtaataactataaaatgataatgacaataatggccaacattttttgagggcttacttaccaaggaacagtcctaagtgctttacttctgttacctcatttaatcctcaaaacacctcaatgagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctg

SEQ ID NO: 182523 - DNA, 760 bp, Homo sapiens
  Payload ID: 15960
  Gene Symbol: SMG7
  Gene Name: SMG7 nonsense mediated mRNA decay factor
  ENST ID: ENST00000507691
  CDS Start-End: 311-760
aggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggattgctgggaggagtaataactataaaatgataatgacaataatggccaacattttttgagggcttacttaccaaggaacagtcctaagtgctttacttctgttacctcatttaatcctcaaaacacctcaatgagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtg

SEQ ID NO: 182524 - DNA, 4642 bp, Homo sapiens
  Payload ID: 15960
  Gene Symbol: SMG7
  Gene Name: SMG7 nonsense mediated mRNA decay factor
  Uniprot ID: Q92540
  ENST ID: ENST00000507469
  CDS Start-End: 119-3655
agccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaa

SEQ ID NO: 182525 - DNA, 3985 bp, Homo sapiens
  Payload ID: 15960
  Gene Symbol: SMG7
  Gene Name: SMG7 nonsense mediated mRNA decay factor
  Uniprot ID: Q92540
  ENST ID: ENST00000508461
  CDS Start-End: 216-3653
aggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaa

SEQ ID NO: 182526 - DNA, 3263 bp, Homo sapiens
  Payload ID: 15961
  Gene Symbol: SMG8
  Gene Name: SMG8 nonsense mediated mRNA decay factor
  Uniprot ID: Q8ND04
  ENST ID: ENST00000300917
  CDS Start-End: 43-3018
tttactaacggaccggaaggactctagagaacgctctgcactatggctggtcccgtgagcttgcgagaccttctaatgggagcatcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatg

SEQ ID NO: 182527 - DNA, 3477 bp, Homo sapiens
  Payload ID: 15961
  Gene Symbol: SMG8
  Gene Name: SMG8 nonsense mediated mRNA decay factor
  Uniprot ID: Q8ND04
  ENST ID: ENST00000543872
  CDS Start-End: 265-3240
cactctgtcgcccaggctggagtgcagcggggtgatctcggctcactgcaacctccacctcctggttcgagcaattctcctgcctcagcctcctgagcagctggaactacagttgaggaaacaaactaggagaggagaagaggaggcggaactcaagtgacgggaaagcaggaactgaagaagcggaggaaggatttcaaaattggacgaaagccggtcggttttactaacggaccggaaggactctagagaacgctctgcactatggctggtcccgtgagcttgcgagaccttctaatgggagcatcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaata

SEQ ID NO: 182528 - DNA, 2178 bp, Homo sapiens
  Payload ID: 15961
  Gene Symbol: SMG8
  Gene Name: SMG8 nonsense mediated mRNA decay factor
  Uniprot ID: Q8ND04
  ENST ID: ENST00000578922
  CDS Start-End: 186-1952
tgttttttgtttttgatatctcaattcctacagttgaggaaacaaactaggagaggagaagaggaggcggaactcaagtgacgggaaagcaggaactgaagaagcggaggaaggatttcaaaattggacgaaagccggtcggttttactaacggaccggaaggactctagagaacgctctgcactatggctggtcccgtgagcttgcgagaccttctaatgggagcatcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggtagctaaaatttgttcagcattttgaaataaaaactttgagctgtgttttcattcttgttttaagatagtctgttcactatgtattgatattttagaaagagccctacagaaatttaggtgcatcagctatacgttttctctcctgctgtaaaaggaaaatatcagctatgactactttcttattttttttcatttaaaggatacgtcctagtgaattggtaagtgagaatta

SEQ ID NO: 182529 - DNA, 1144 bp, Homo sapiens
  Payload ID: 15961
  Gene Symbol: SMG8
  Gene Name: SMG8 nonsense mediated mRNA decay factor
  ENST ID: ENST00000582469
  CDS Start-End: 1-816
gtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaacttt

SEQ ID NO: 182530 - DNA, 583 bp, Homo sapiens
  Payload ID: 15961
  Gene Symbol: SMG8
  Gene Name: SMG8 nonsense mediated mRNA decay factor
  ENST ID: ENST00000580798
  CDS Start-End: 1-97
attttggagcaatggccatcagctctgtgaggagaggagtttaactgatcaacactgtgtgcacaaatttcactcattacctaaatcaggtagctaaaatttgttcagcattttgaaataaaaactttgagctgtgttttcattcttgttttaagatagtctgttcactatgtattgatattttagaaagagccctacagaaatttaggtgcatcagctatacgttttctctcctgctgtaaaaggaaaatatcagctatgactactttcttattttttttcatttaaaggatacgtcctagtgaattggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataa

SEQ ID NO: 182531 - DNA, 5510 bp, Homo sapiens
  Payload ID: 15962
  Gene Symbol: SMG9
  Gene Name: SMG9 nonsense mediated mRNA decay factor
  Uniprot ID: Q9H0W8
  ENST ID: ENST00000270066
  CDS Start-End: 344-1906
atccacgcacgctcagcccggcgagcgcattcagttctcgagctccagccctcagcgcatgcgcaggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctgttcttatgttccacttactcctctacccaccatgcagctctgggaagcaggacaaattggacacccagcccttgcgggcagatggagatcagtctctgctaagaagtccctagaaggggttattctgtttcctggggtggcatcaagcctcccctgtgtatgttttggatgggaaaatacactggtgcagctgagtacagcaactaccctcgtgtcttctgctctcacttaaagacagttacctgcctttgggttaaatgcccagttaaatacagtgcctaggctgggcatggtggctcacgtctataatcctagcactttgggaggccgaggcaggcggatcacttgagatcaggagttcgagaccagcctggccaacatggtgagaccctgtctctactaaaaatacaaaaaaaaattagctgggcgtggtggcgcacgcctgtaatcctagctacttgggaggctgaggtgggagaactgcttgaacccgggaggcagaggttgcagtgagccaagatcacgccactgcactctccagcttgggcaacagagcgagactccgtctcaaaaaaaaaaaaaaagcctacttttgacttaagaaacagaacttgtccttaaatgtagtaagtacttacccttaatccaaataccatgcctcacccgtacagacagtgccttctgttggttaaatacagtggctttcctctcgtaaacctcatctactcttgcttagaaatggcaaccctcacctttaatgtaaatccagaacctaccctcagttaaatccactctgcgatttggtacagtaccaaccctcatctgctcagttaaatacagtacatgatcttagtttgaggtttcccaaagtatgtctccaaattggtctcgccaccccaaattaatccatcgttcagtaaagcagtcagctccagtccagctggctgagtctgttcatccattgccctcccccaccccctgccgcccgtggcacatatttgtctccctggtttcctcctgctttcaagcatcccatacagccctggtgtttcataccatggggatccagggccttgtgagaaacaactgaagtgagggggggcggggggtcagtgaagaaagcactcagcagggccagagaaggtcaggccagaagtggatagaatgccagtctctacagagggctgaggcctgggagacaggaggcccagcacaggctctggcacagccacttcctgaccgactgtagtaggcaaggagcctcccctctctggccattattccaacatttaagatcatcctcgaggcccttcagagctgtgacattcactgcccttttaccgaaatgcttctaaatcctttgccccactgtcgtgatctctacagaaccctcctgaccatcctctccagctagataacccagctcttccctgccttgtcaaaatgtctgccccaagtctcatccccacccctgcttccccagggggtcttcctgctggttgatttgggggtttgccagagtaggaaaggtggtgggggcaacggccagagaaagatgggagacccaaggcaagacggcaccagacagcatgcaactcagtccaggagagttggagcttcagtttcttccatcccagcccctttcagcacaaggctggggacagagagaactgtgccctcccagccctaacctaccacctcctgctggcccagctcagggctgagattgttgattggattcacctgtgatcttgtggtcagtgttgccaaggaaggtctgaatcagcacactcttggtgtccctggctgccaaatccaggggcgtgtgaagcatccggtagatggtggtgaaggaggtgctgcaggtgaccaggatgcccggatgggtgaaatgaggcactctggaaatccggcctagcgtttccaccaccaccaccgtggtgatctggtgaccttggtccaaaggccctgtcccacctccagggttttgtgcaggggctggctcgttgaggcagtttgacagaggagtcaaactggcagtagccttctgaacagtgggtaagtatgtaccggtcacccgccaccccctttacatccagcagaggactcaggctgatgctgccagcaggccactgtggacaccagctagatatactgctgcagggaggccttctgctctaggatgggctgcaagatgggcctggccaccaggaatgcctgctgcttgtggctctccagtcccttcatcattcccagcaggtggaactcacgcttttcaattcagacacaggaatacattggtatccttctcaccctccactgcaggaaacatgagcaccgctcaatcagcttctacactggagcaggccatgttgtgctggcagctgcctgggctcaagcgcctgtcatgagcgcagcacttggcctaagaatgtcagccctgcagccaggctgcctatgttcagatcccagccttgccatctaccacctgtgtggcattggacaagttgctaaagcttgctgggcatctgttttgtctgcaaaataaggtgatgattgtacctacctcctaggggtgttgtggtgattaattgagttcataatggtgtctgttttagtcggttcttgcattgctgtaaggaaatacctgagactgggtaatttataaagaaaaggggtttaattggctcagagttctgcaggctgaaccagaagcatggtgctggcatctgctcggcttctggggaggcctcaggaaacttacaatcatggcggaaggtgaactgggagcaggtacttcacatgcccagagcaggagcaagagggggcaggtggcacacactttgaaaccacgagctcttacaacagattcactattgtgaggacagtaccaaggggctggcgctgaaccatgagaaaccacccccatgatgccgtccctcccgccaggccccacctccaacagtggtgactacaaactacaagttgacatgagatctggtggggacacagatccaaaccatatcagtgcctgacctatgctgagcctcaataaatgttaaatgccaccatcatccacaggtgccaggtctgcattgggcacatagcattttgcaatcctctaactttgcaaataaatgagccaatacatactctt

SEQ ID NO: 182532 - DNA, 438 bp, Homo sapiens
  Payload ID: 15962
  Gene Symbol: SMG9
  Gene Name: SMG9 nonsense mediated mRNA decay factor
  ENST ID: ENST00000599804
  CDS Start-End: 78-438
gcgcgaggctagcgcaccggcggcgggcggggcgctccggcaggccccgcccccgccttggccattgaaaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagg

SEQ ID NO: 182533 - DNA, 550 bp, Homo sapiens
  Payload ID: 15962
  Gene Symbol: SMG9
  Gene Name: SMG9 nonsense mediated mRNA decay factor
  ENST ID: ENST00000601925
  CDS Start-End: 105-550
gctagcgcaccggcggcgggcggggcgctccggcaggccccgcccccgccttggccattgaaaggtcgctgggacgtccggcgggggtgcggcactgagtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagat

SEQ ID NO: 182534 - DNA, 650 bp, Homo sapiens
  Payload ID: 15962
  Gene Symbol: SMG9
  Gene Name: SMG9 nonsense mediated mRNA decay factor
  ENST ID: ENST00000602222
  CDS Start-End: 100-650
gcgcgaggctagcgcaccggcggcgggcggggcgctccggcaggccccgcccccgccttggccattgaaaggtcgctgggacgtccggcgggggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggt

SEQ ID NO: 182535 - DNA, 576 bp, Homo sapiens
  Payload ID: 15962
  Gene Symbol: SMG9
  Gene Name: SMG9 nonsense mediated mRNA decay factor
  ENST ID: ENST00000596714
  CDS Start-End: 231-576
gctccggcaggccccgcccccgccttggccattgaaaggtcgctgggacgtccggcgggggtgcggcactgagtagggggccggcgaccgtcaattcgatactgggttggcaggaatgggggcgggggacggaaataacgtgtaaatgagaaacttatgctctgcgagatccaagtacagcctgcaaactgcccgtcaagtactggggaggccgccccaataacgtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtg

SEQ ID NO: 182536 - DNA, 2387 bp, Homo sapiens
  Payload ID: 15962
  Gene Symbol: SMG9
  Gene Name: SMG9 nonsense mediated mRNA decay factor
  Uniprot ID: Q9H0W8
  ENST ID: ENST00000601170
  CDS Start-End: 316-1803
attcagttctcgagctccagccctcagcgcatgcgcaggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggtaagagctctttgcagagggggtcaatttgaggcaccccaccctggtgtagagagaagggggcgtcccttagatcggcatgaccttgtgaagcccctcctctccagatcccaggttccttttctggaacagtgatgattgctactgtcttgtaagcatctcacccatgtggcaacatgctgtttcctgtgactttgaatcctcctaatcagccagcatcatgtaggtccttgtcaccagttttcctggtggggaaatttaggctcggggaaaagtgttacatagcaaggccacacatctgtggctaggagtcatttgattgctaggagtaggaccagtgaccagatttagcttaaggaagatttattccagggacctgatcacagaaagcagggccctgcagcagatgggaaccaggaagccatcagggtctcattcttcacacttctgcatttgtcttgtttcctgcctctggctttctctccctgctttcacttggcccggcactagctctgtggcccctactttacattacttctttgtccagagctctcagcatatgagtccaggtcttcctcatcttacttc

SEQ ID NO: 182537 - DNA, 1077 bp, Homo sapiens
  Payload ID: 15962
  Gene Symbol: SMG9
  Gene Name: SMG9 nonsense mediated mRNA decay factor
  ENST ID: ENST00000597598
  CDS Start-End: 1-473
ctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacaggtgccagccccgcctgcctttgccccaccctgccacatcctgcattgagcctcttcctggaatgtgattaagccagaaccctgcgtggattccatgtgcttccagtcaagccatggacatactggctgccctggggcaaattgtgtcttttcttggcccttagtctcttgtcacttttgcccccatctcattcgccttctacacagtagcctaaaggatttctagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccac

SEQ ID NO: 182538 - DNA, 697 bp, Homo sapiens
  Payload ID: 15962
  Gene Symbol: SMG9
  Gene Name: SMG9 nonsense mediated mRNA decay factor
  ENST ID: ENST00000597586
  CDS Start-End: 230-697
ccggcaggccccgcccccgccttggccattgaaaggtcgctgggacgtccggcgggggtgcggcactgagtagggggccggcgaccgtcaattcgatactgggttggcaggaatgggggcgggggacggaaataacgtgtaaatgagaaacttatgctctgcgagatccaagtacagcctgcaaactgcccgtcaagtactggggaggccgccccaataacgtgtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcact

SEQ ID NO: 182539 - DNA, 8279 bp, Homo sapiens
  Payload ID: 15963
  Gene Symbol: SMCR8
  Gene Name: Smith-Magenis syndrome chromosome region, candidate 8
  Uniprot ID: Q8TEV9
  ENST ID: ENST00000406438
  CDS Start-End: 481-3294
cggcgccgcggtagcaggatccgggttgtggcgtcctaggagccgcgacggtttctgccctcgggcagtgaggggcagcagcgcttggctgacccctgcggcgtcccgtagcctcgcgttaagccttgttcagagcgggggcttttgctgtcgcagtgggttccggagagtgcaggtgatttcgcagcaggtttcttgtgctggccgcgctcgccggacgaagaagagaagggcagttgggcctgcggccttggcgttcatgaggcctcagagagctccggaggagctacaactgtgagggggctgctagagttcttctcctcgggtgtgtgagaagcagcctaggaccccgggttcggggagtcgcaaagaaggccgtaagggcttcacttccttctccggaggcctgccttctgcgcgtcgattaacaccgcattctttcccacttcctctcaatgttttcttcatatatctggaaatatgatcagcgcccctgacgtagtggccttcaccaaagaggaagagtatgaagaagagccttacaatgagccggccctgcctgaggagtactcggtgccgctcttccccttcgccagtcagggtgctaacccctggtcaaaactgtccggggccaagttttcgagggacttcattcttatttccgagttctctgagcaggtgggaccccaacccttactgaccatccccaatgacaccaaagtttttggcacttttgatctcaattacttctccctgcgtatcatgtctgtggattaccaggcttccttcgtgggccatcctcctggatctgcctaccccaagctgaacttcgtggaggactccaaggtggtgctgggagattctaaggagggcgcctttgcatacgtgcaccaccttaccctatacgacctggaggcccgtggcttcgtgaggccgttttgcatggcttatatctctgcagaccagcataaaatcatgcagcagttccaggagctttcagccgaattttccagagcttctgagtgcttgaagactggcaacaggaaggcatttgctggggaacttgaaaaaaagctgaaagacttggattacaccaggacagtgctacacacagaaacggagatccagaagaaagccaacgacaaaggcttttactcatctcaggcaattgagaaagccaatgaactggccagtgtggagaagtccatcattgaacatcaagacctgctgaagcagatccgctcataccctcatcggaagttgaaggggcatgatttgtgtcctggtgagatggagcacatccaggatcaggccagccaggcatccactacctctaaccctgatgagtctgccgacacagacctttacacctgcagaccagcctacaccccaaaacttatcaaagcaaagtccaccaagtgttttgacaagaagttgaagaccttggaggagctctgtgacactgaatatttcacccagaccctggctcagctcagccacattgaacacatgttcagaggagacctgtgttacctcctgaccagtcagattgatagagcacttctaaaacaacagcatataacaaactttctctttgaagactttgtggaggtcgatgacaggatggtggagaaacaagaaagcataccctctaagcccagtcaagacaggccgccttccagttctctagaagaatgcccaattcctaaagtgttaattagtgttggttcttacaagtccagtgtggagtctgtgttgatcaagatggagcaggaactgggagatgaggagtacaaggaagtggaagtgactgagttgagcagtttcgacccccaggaaaacttggactacctggatatggatatgaaagggagtatcagcagtggtgaaagtattgaagttttgggcacggagaaatccacctccgtgctttctaaatctgacagccaggcaagcctcacagtaccattgagcccccaggtggtccggagcaaagcagtcagccacaggaccatcagcgaggacagtattgaagtcctcagtacctgcccctctgaggccctcatccctgatgactttaaggccagctacccaagtgccattaatgaagaagaatcatatccagatggcaatgaaggagccatccgcttccaggcaagcatcagtcctccagaactgggtgagacagaggaaggcagcatagaaaacaccccatcacaaatagactcctcctgctgtattgggaaggagagcgatggtcagttggtgctgccctccactccagcccacacacactctgacgaggatggggtggtgagcagccccccacagcgccacaggcagaaggaccaggggttccgtgtagacttttcagtggaaaatgccaacccttcttcccgagacaacagttgtgaagggtttcccgcttatgagctggacccgagccacctgctggctagccgggacatcagtaagaccagcctggacaactactcagacaccaccagctacgtgagcagtgtagcgtccaccagctcagacaggatcccctctgcttatcctgctggcctgtcttccgataggcataaaaagagggctggccagaacgccttaaaattcatccgccagtacccctttgcccacccagccatctactccctgctcagtgggaggacacttgtggtcctgggggaagatgaggccatagtcaggaaactcgtgactgcactggctatctttgtccccagctatggctgctacgctaagcccgtgaaacattgggcctcctcccctttgcacattatggattttcagaagtggaagcttattggcttgcagagagtggcctcccctgccggtgccggtaccctccatgccctgagccgctacagccgctacacgagcatcctggaccttgacaacaaaaccctgcgctgccccctttacagaggcaccctggtgccccgcctggcagaccaccgcacacagatcaagcggggcagcacctactacctgcatgtccagagcatgctcacccagctctgctccaaggccttcctctacaccttctgccaccacctgcacctgcctacccacgacaaggagacagaggagctggtagccagccgccagatgagcttcctaaagctgaccctgggtctggtgaatgaggatgttagggtggtccagtacctggctgagctgctgaagctgcactacatgcaggaatctccagggaccagccaccccatgctcaggtttgactatgtccccagctttttgtataaaatctgaggtcggtcccagacactgtgaccaagacctgtgactcagggtatggggaggggaggggttggcatgaccaaacagttgcctgagctggactgtttaagtttctggtgtctggcagcatggttcccacgtggctcctagtagtttttaagttggacatgggcagaagtggagcctggctccctctaaaggcgtctggagggatggtgacagctacatttggctccctggtgaagagtggcccctggatatggagggggccttggttttctgaggactggcagccagggcagaagggaagccaccagtcccttggtggggcagggtgagggcaggaaggccaaagcctgatgggaggagcacactggctgtattcagcattgccggacacttgagtggcaaaatgaacgagggtgacagccaggtaactgttgtggtttggtggaaaacaggagggcagaacacccatcgcctccttcagacccagatgcagccctttatttgcttcctggagcccactgtcctaggggaggccctggaccagccagtgggggtgagaaaggctgccaccctctgggtcgtgggaaacatgcgaccttggcctcagggccacagagcgtgagcagcaccctgtccgctgtcctcgccacctttacctgggagagaagtgcctgtgagcgggccttgggactcactccccatactctttcaccaggaacgagcagagtgttcactagtcctagtgtgaagcgggcacaagtgaccaaagccaatggtgaggaccaccttgggggctggagagcacagcaggcagagcagggctgaggcgccatgaggccatcaccaccatgcaagggaggagcagccagcagctctcctgggtggcccactggctcctgccggccagagcgcatgagcactgaccttcctcgtggggaaggtctgcagacccgtgtgaacatggcagaggccacactccagctcccacccacataaacctttgcaaccacttcactacctctcactgggtctcgtgggcttgggacagcaacggttctgtttagtcagctggtgcaggtggttggcccagccgatgagaactcaaatagcacggatttcctggatgagctaccacgtggcgctcttcaggttctgcctctgggaggctgtgtgcacctcagtcaccacagctcacggccgtccccagttgagtcccccttctgaggacaagtttgaaactgggaaggagacaccccctggttccgccagcacctatcccactgatagtgatcccctggcctccccgagcctccttaggcaatggccactggtttgtagacagagagtttcttgcagccttgaaaattttattccctaagtggggacagctctggtattactgcttctttaatttgttccacaaaaattatgctgaaatggacctgaatcagccctgggtgtgcttctgttggcgcctgctgctgaggcccggcctgcccatcggcctgtagtacgccatcgaggtcatcatggagccagccagcttctcttctcatcaaggaggcagagacccctggtggaagccaagagtgaccgaagagggcttgcatcacgtcactccagtggttccctccttgtccaagtcctcgttttaagggcatggcccgttggctccagccgttggcttctgttcagggtccttgctcccatcagaggtgtttgattttgctcctggggctgcgatggagaaccttttgtggcagatggtgctgcctacatctcattggttctctgtacctgtgcccgttgcgcatgttcacagacaggagagtcgccagcaataccttggcagcctttaaatgtgaaacgtctgttacttgcgctggaggcagaggctgtgcagggagcctgcttctaatcgtgggctcccttatctgttacggttccctcccctcctgttctagatgctgattcgttttctcactggctggttaattgctgtctacttaggcctccaaggccataactgtgcaacattttatctgagaaggaaggaaggtcagaaagtgatcactggcaccaccactgtggcattcctgtcacaccaacacagaaattcacagctcatactgttctcacctgggaaacttgggaagggctgatgagtttggggcagatcctgaattgcagccacacttggccttctagaagctgaagttgtgccctcaagtggtcctaagtagaagtccacttgaggtatttgctggcacacaccctcaagggtggttcagaaggtcctgaaacctaaggcaaaaggctgctggggcatgaacagaacagaccgtctcaggggcagccatgtaagtggcaagcagggctggtctccctcaaggtggttcttcattaagtaaagatggcttcgtgactagtgtttagctcccagatttatatttgggttaaaaactaacttttcaatgtggcagtttcaaaggattacttgatgcaaagtatgtttcctttcaaagggatcttgacgtggtaccaggactgagtcatgatttgggcagaggcagttaacactgggaagccctgcccctccctatgcccccttcactccggggaactgaaacctactctgagtctcacatctctaaacctcagtgctgagacctatgcagtgggactaatctcatcaagaattttcagttgaggccgggcgcagtggctcacgcctgtaatcccaacactttgggaggccgaggtgggcggatcacctgaggtcaggagttggagaccagcctggccaacatggtgaaaccccatctctactaaaaatacaaagaaagttagccaggtctggtggtgcgtgcctgtaatcccacttactcgggaggctgaggcaggagaatcacttgaacccaggaggcagaggttacagtgagccgagatcgcgccactgcactccaccctgggcaacaagagcgaaaactgtctcaaaaaaaaaaaatttttcatttgaggtattcttccagtagaaggttagtaagtttttaatgaaaccattaaaaattacacttcccagaaaatagatgacatcagtgccccttgctactttctcagtcctcactattgctttgagggcccaggtactgaaactggttgtcttgagttttgtgtcagctttttctccagtccattatccccctcccttgcttctgaagcagtctaggttaaactagccaggcaggtagttgtggactggtgattttcaaaagccccactttagagatcaggccacagctttttatatcgcacaggacacatcagcctgagctgctgcctcatgcctgtttccccaggaacctcactcctttggtagaaccttgggattttagaaattgtggcttttccataactcatttactccaacagttgaagttacacacattgctcccaaatttggaaatagaccacagtaccttacctttcattccccatctggcctttaccttctttgcttcagtggttgaaaacagttgccatattcaaagtatagtagatttcaacctcacacaaatgacaagtcccattttacaatcctaggaaggcccaccaatttcatttcacgcgccagggcggctgcagttggaggccgagggcagccctctgctcactgaatgtcttgcatgtgctgactgctgcccgcagtgctgaacatgccccaccgcccaggcccagcactgcttgttgggtcagcatctagtgctgctgtcacatctttgtctgcacagccagtaggattgcctcagccagggggtttatcagaaggtgtgcaaggcctttgggggaactgagcccctatagtgggcagtctcctttaccttcccacctccctgaaaagcacagaagacagtgccttggtttgtgttttgaagcaaacaagtcagctttctggctttgccccaaaactgtgatggaacataataaaactggagatatggtttttaacactgcaaaaaggaaaaagcatcaagtttctacttctggctggaaagcaaaaccaatctcagctgacaaggctgggcaaactaagttttcctgagcccattttcctttgagccctgacctagcctggccttacctcattaaggtttggttaaagcagtggaaaggaggaggaggcaggggtggatgggggtgtggggaggggatgagcactctgcagccgattaatctgttggtaggggcccagcttcttgggagtgcttattcagcccaagagtggaggctgtttacagcgagccctggagatggcagcttgtctccagctggggaggggtcaggcccctaaattgaagaccactttggtagcagaactgtagggactggtgagtcaactcacagattctgcagcagctgctccacccacaataaagcaaacgccgacaggctagaccccagattgcaggggctgccacctacaaggtgggaccacaggctgcctcaccgggattgtctgccactaaatagctggagtcacagattgagataaatgccaccttcaaggttgcagtgaaaagcataatcctatgtgatgaatttatatgtgttattttttaaaaagctattttattactgcatgttcccgtcccgtcttgtgaatgtgagtccccgccaccacgtgaggtgcagtcgttgcagcggctggtgcaggagtgcagctggcgcgtgtgtgatagcatctcgtaggtgttgctgcacaagagttaaccagagtcaatgccaaacacatagtatgagaagtgtactttttaagaaattaatttatttgagttcaaatatttttgaaatataaaaattggttgtattttttaaagctataattcttgtagacattctgtggttaaaaatttgattgtgcttattaaaaatggtcatctatgttttgcacttcagctacgtgaaaataaaatttctttgggaaggtg

SEQ ID NO: 182540 - DNA, 3130 bp, Homo sapiens
  Payload ID: 15964
  Gene Symbol: SMTN
  Gene Name: smoothelin
  Uniprot ID: P53814
  ENST ID: ENST00000347557
  CDS Start-End: 219-2972
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacga

SEQ ID NO: 182541 - DNA, 3295 bp, Homo sapiens
  Payload ID: 15964
  Gene Symbol: SMTN
  Gene Name: smoothelin
  Uniprot ID: P53814
  ENST ID: ENST00000333137
  CDS Start-End: 219-2966
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacga

SEQ ID NO: 182542 - DNA, 3198 bp, Homo sapiens
  Payload ID: 15964
  Gene Symbol: SMTN
  Gene Name: smoothelin
  Uniprot ID: P53814
  ENST ID: ENST00000358743
  CDS Start-End: 219-3041
cagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 182543 - DNA, 1735 bp, Homo sapiens
  Payload ID: 15964
  Gene Symbol: SMTN
  Gene Name: smoothelin
  ENST ID: ENST00000404574
  CDS Start-End: 91-1407
gaccagctgcaaagactcagacactcagccagagacagcagcccctgccactgccccaccattaccccccatagagtccccaccagcaccatgccgggggtaccagggcctgggcctgagctggccgcagcccttgaggagcagttgggccgggcactggaggagctgcgggcggtggctgaagcaggccgggtggcagtgacccaggcagccgaggtagctgtagccaccgtggagccggtggcccgggcagctgaagagctgcgggcagagagagcagcactgagccggcggctggatgcactgagcaggcaggtggaggtgctgagcctacggctgggggtcccacttgtgtccggccttgagcctgagctggagcccagcgagctgctcctggctgccgccgaccccgaggccctctttcaggctgccgaggatgccgggacccccgtggcccacccacctgccttcagcacccgccgccgctcctccaccggcaccacccgcagcactagtctcatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 182544 - DNA, 566 bp, Homo sapiens
  Payload ID: 15964
  Gene Symbol: SMTN
  Gene Name: smoothelin
  ENST ID: ENST00000422839
  CDS Start-End: 456-566
gtaacaacatggcagctcccatgagaacggcatggttggagtcagaagaggaagaagcagaactgggcaggactccagaccccatcctcccaactccacccactttagtctccatggagacccaagggcggctttagggcctctggcactgaagatggaatagctttgccttgtggatctgacctcctgggtaccctggctgattccttgtttggtcttggacatgtcagctctctctgggcctcaatttcccccttttgctgaatgacagcctggactccatattccctatttaggactccagcgctcctaaaggcagactctcagggcttggaaggtagaagcatgctacaagaaggcaatgtctgttcaaagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactg

SEQ ID NO: 182545 - DNA, 648 bp, Homo sapiens
  Payload ID: 15964
  Gene Symbol: SMTN
  Gene Name: smoothelin
  ENST ID: ENST00000455608
  CDS Start-End: 1-648
ggatccactagccgggagctcagccgggaaagggatccccaagcgggccacccggctgcccagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggc

SEQ ID NO: 182546 - DNA, 534 bp, Homo sapiens
  Payload ID: 15964
  Gene Symbol: SMTN
  Gene Name: smoothelin
  ENST ID: ENST00000431481
  CDS Start-End: 61-534
attgtgccctaggcagagccgtgggcagctggtgccagccctccgcccctggcagccaaaatgacctgcctctcgcacccactgcagctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacag

SEQ ID NO: 182547 - DNA, 567 bp, Homo sapiens
  Payload ID: 15964
  Gene Symbol: SMTN
  Gene Name: smoothelin
  ENST ID: ENST00000432777
  CDS Start-End: 294-567
agctgtggggtctgtaacaacatggcagctcccatgagaacggcatggttggagtcagaagaggaagaagcagaactgggcaggactccagaccccatcctcccaactccacccactttagtctccatggagacccaagggcggctttagggcctctggcactgaagatggaatagctttgccttgtggatctgacctcctgggactccagcgctcctaaaggcagactctcagggcttggaaggtagaagcatgctacaagaaggcaatgtctgttcaaaggtttagacaggatgagagtccatcccaggccacacagcagactggcggccaagctggcagggctggaaccagagaccccctaccctgggtttgaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgc

SEQ ID NO: 182548 - DNA, 574 bp, Homo sapiens
  Payload ID: 15964
  Gene Symbol: SMTN
  Gene Name: smoothelin
  ENST ID: ENST00000426927
  CDS Start-End: 151-574
gcagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagaggtttagacaggatgagagtccatcccaggccacacagcagactggcggccaagctggcagggctggaaccagagaccccctaccctgggtttgaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagt

SEQ ID NO: 182549 - DNA, 599 bp, Homo sapiens
  Payload ID: 15964
  Gene Symbol: SMTN
  Gene Name: smoothelin
  ENST ID: ENST00000440425
  CDS Start-End: 145-599
gcagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagacaggatgagagtccatcccaggccacacagcagactggcggccaagctggcagggctggaaccagagaccccctaccctgggtttgaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcact

SEQ ID NO: 182550 - DNA, 545 bp, Homo sapiens
  Payload ID: 15964
  Gene Symbol: SMTN
  Gene Name: smoothelin
  ENST ID: ENST00000438223
  CDS Start-End: 164-545
gacaaatccttggccctctccaatcttctcagtttgcctgaaatccaggggttgggcaggtcagcttctgaaagcccttccagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccacct

SEQ ID NO: 182551 - DNA, 823 bp, Homo sapiens
  Payload ID: 15964
  Gene Symbol: SMTN
  Gene Name: smoothelin
  ENST ID: ENST00000416786
  CDS Start-End: 530-823
ggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggggaaccctgggccagtcctctctcccttgagccacggaggatctgtatgtagcaggtggctctacatggtggaggtgtgggggaggcaacaggattggctgactcactccagagaagctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccaca

SEQ ID NO: 182552 - DNA, 3321 bp, Homo sapiens
  Payload ID: 15964
  Gene Symbol: SMTN
  Gene Name: smoothelin
  ENST ID: ENST00000612341
  CDS Start-End: 78-2993
agcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcaggctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 182553 - DNA, 3227 bp, Homo sapiens
  Payload ID: 15964
  Gene Symbol: SMTN
  Gene Name: smoothelin
  ENST ID: ENST00000619644
  CDS Start-End: 62-3070
ttgccaggccctggcttctcaatccaggtccctgccctccctgttttgaggtttagacaggatgagagtccatcccaggccacacagcagactggcggccaagctggcagggctggaaccagagaccccctaccctgggtttgaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaaggctgccgaggatgccgggacccccgtggcccacccacctgccttcagcacccgccgccgctcctccaccggcaccacccgcagcactagtctcatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 182554 - DNA, 1263 bp, Homo sapiens
  Payload ID: 15964
  Gene Symbol: SMTN
  Gene Name: smoothelin
  ENST ID: ENST00000624247
  CDS Start-End: 1-934
gcggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacga

SEQ ID NO: 182555 - DNA, 589 bp, Homo sapiens
  Payload ID: 15964
  Gene Symbol: SMTN
  Gene Name: smoothelin
  ENST ID: ENST00000482444
  CDS Start-End: 575-589
gcagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgccaaaatgacctgcctctcgcacccactgcagctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcacccacatcctccacgacctggccatggcagtggtggttacagtcatgatgtctctgcagctctcagcagcgggaagctgagcagcgggctgccctggcacggctggcagggcagctggagtccatgaacgatgtggag

SEQ ID NO: 182556 - DNA, 1536 bp, Homo sapiens
  Payload ID: 15965
  Gene Symbol: SMTNL1
  Gene Name: smoothelin-like 1
  Uniprot ID: A8MU46
  ENST ID: ENST00000399154
  CDS Start-End: 1-1374
atggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacagttgtggaggatgaggctaaggctgaacccaaggagcccgatgggaaagaggaggccaaacatggtgcaaaagaggaggctgatgagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctg

SEQ ID NO: 182557 - DNA, 1649 bp, Homo sapiens
  Payload ID: 15965
  Gene Symbol: SMTNL1
  Gene Name: smoothelin-like 1
  ENST ID: ENST00000527972
  CDS Start-End: 3-1487
agatggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacaggccagaggaaagagtgcagcactgaacccaaggagaaggctactgatgaagaggccaaggctgaatcgcagaaggctgttgtggaggatgaggctaaggctgaacccaaggagcccgatgggaaagaggaggccaaacatggtgcaaaagaggaggctgatgcaaaagaggaggcggaggatgcagaggaggcagagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagtgagtcttcacccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctg

SEQ ID NO: 182558 - DNA, 1919 bp, Homo sapiens
  Payload ID: 15966
  Gene Symbol: SMTNL2
  Gene Name: smoothelin-like 2
  Uniprot ID: Q2TAL5
  ENST ID: ENST00000338859
  CDS Start-End: 134-1087
gacagcgcgtagtcgcagagtcagggaggggacctcaccacctgtctcctccctgaggtcttagaacagatacaagaaattccaggcgaaggtcccacagagtttggatcacgatgaggccagtgagtcggagatgagaaagacctcaaactcctgcatcatggaaaatgggcaccagccgggggcaggtccaggcgatggaccccctgagattgcccaaaacttctcagcaccagatccccccaggcctcgtcctgtgagcctctccttgcggctgccccaccagccagtcacggccatcacccgagtctctgacaggttctctggggagacctcagctgcggctctatcacccatgtctgctgccaccctggggggcctcaacccaagccccagcgaggtcatcacgccctggactcccagtcctagcgagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaattttg

SEQ ID NO: 182559 - DNA, 2280 bp, Homo sapiens
  Payload ID: 15966
  Gene Symbol: SMTNL2
  Gene Name: smoothelin-like 2
  Uniprot ID: Q2TAL5
  ENST ID: ENST00000389313
  CDS Start-End: 68-1453
cggagctgcggagctcggatcttctcccccgtctggcccgctctcgacccgcgcgctctgctgggccatggagccggcccccgacgcccaggaggcgcgcactgtgcgcgaggcgctgggccgctacgaggcggcgctggagggtgcggtgcgcgcgctgcacgaggacatgcgggggctgcagcgcggcgtggagcggcgagtggcagaggcgatgcgcctggccggccccctggcgcgcacggtggccgacctgcagcgggacaaccagcggctgcaggcgcagctcgagcgcctgacgcgccaggtggaggcgctgggcttggccagcgggatgtccccggtgcccggcactcccggcacgcccagccccccgcccgcgcccggggttcccgaccgcgcgccccgcctgggcagcgcacgcttcgccagccacgccaccttctcgctgtccggccgcggccagagtttggatcacgatgaggccagtgagtcggagatgagaaagacctcaaactcctgcatcatggaaaatgggcaccagccgggggcaggtccaggcgatggaccccctgagattgcccaaaacttctcagcaccagatccccccaggcctcgtcctgtgagcctctccttgcggctgccccaccagccagtcacggccatcacccgagtctctgacaggttctctggggagacctcagctgcggctctatcacccatgtctgctgccaccctggggggcctcaacccaagccccagcgaggtcatcacgccctggactcccagtcctagcgagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaa

SEQ ID NO: 182560 - DNA, 286 bp, Homo sapiens
  Payload ID: 15966
  Gene Symbol: SMTNL2
  Gene Name: smoothelin-like 2
  ENST ID: ENST00000572951
  CDS Start-End: 40-286
ctgtagagtttggatcacgatgaggccagtgagtcggagatgagaaagacctcaaactcctgcatcatggaaaatgggcaccagccgggggcagagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgcccc

SEQ ID NO: 182561 - DNA, 3738 bp, Homo sapiens
  Payload ID: 15967
  Gene Symbol: SMO
  Gene Name: smoothened, frizzled class receptor
  Uniprot ID: Q99835
  ENST ID: ENST00000249373
  CDS Start-End: 281-2644
gggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtgggatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttcttctgttccatttcagttcagtttcagcggtgccaacctctttgcgtttcctttttgttgatgaggacccagagctgctgcacacactcacctctaaccccctcccctcgctgctgggccccatctccacaggagagactggttcagctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataaa

SEQ ID NO: 182562 - DNA, 787 bp, Homo sapiens
  Payload ID: 15967
  Gene Symbol: SMO
  Gene Name: smoothened, frizzled class receptor
  ENST ID: ENST00000462420
  CDS Start-End: 1-454
ctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtgggatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctggatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtgggtgagcctcacccct

SEQ ID NO: 182563 - DNA, 582 bp, Homo sapiens
  Payload ID: 15967
  Gene Symbol: SMO
  Gene Name: smoothened, frizzled class receptor
  ENST ID: ENST00000475779
  CDS Start-End: 1-213
accaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggttgctctccctgggcaagagtaagtcagggttccaagaactggatttctggcctccagttaggccctttggggacgtgaggcccttctcttcagattctgaaggggtagagatcaccgtggttacaggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgcccc

SEQ ID NO: 182564 - DNA, 7122 bp, Homo sapiens
  Payload ID: 15968
  Gene Symbol: SMU1
  Gene Name: smu-1 suppressor of mec-8 and unc-52 homolog (C. elegans)
  Uniprot ID: Q2TAY7
  ENST ID: ENST00000397149
  CDS Start-End: 52-1593
cgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcggacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactaccactaacggcctctgttgagcccttccttgctatgtaagcagccatatttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcacacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccttggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattacattgttctgagaattaaatatggctgcttacatagtaatgaagggttcaacagaggctgttagtggtagtaataatacaagctgaaaaactacacagacaaacctatcagtttctgcctcttcaggatataactattaggttagtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaag

SEQ ID NO: 182565 - DNA, 786 bp, Homo sapiens
  Payload ID: 15969
  Gene Symbol: SMYD5
  Gene Name: SMYD family member 5
  ENST ID: ENST00000258100
  CDS Start-End: 30-242
aagggtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccag

SEQ ID NO: 182566 - DNA, 2593 bp, Homo sapiens
  Payload ID: 15969
  Gene Symbol: SMYD5
  Gene Name: SMYD family member 5
  Uniprot ID: Q6GMV2
  ENST ID: ENST00000389501
  CDS Start-End: 46-1302
aggtcgaggcggggttaagggtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaa

SEQ ID NO: 182567 - DNA, 660 bp, Homo sapiens
  Payload ID: 15969
  Gene Symbol: SMYD5
  Gene Name: SMYD family member 5
  ENST ID: ENST00000413491
  CDS Start-End: 46-291
aggtcgaggcggggttaagggtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagaatggtgcctggcacatagcagctgctctgtagggctgtgaaagggatagatgtggcctctgctctcaagatattgttgtgtctggctctcaccgtcagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctagg

SEQ ID NO: 182568 - DNA, 584 bp, Homo sapiens
  Payload ID: 15969
  Gene Symbol: SMYD5
  Gene Name: SMYD family member 5
  ENST ID: ENST00000443900
  CDS Start-End: 169-584
ctccgtgcgcatttcctcccagcggaattcggccagcccgcgggaggcccttctgtggctgctcggggcggggctagggggctttgctgctgtatccctggaacggtgggcggggatgtgccgggcagagagaactgaggtgtaaaagagggagtcctcacgaacttcatgtgtgagatttggggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaag

SEQ ID NO: 182569 - DNA, 246 bp, Homo sapiens
  Payload ID: 15969
  Gene Symbol: SMYD5
  Gene Name: SMYD family member 5
  ENST ID: ENST00000629411
  CDS Start-End: 1-246
atggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagaatggtgcctggcacatagcagctgctctgtagggctgtga

SEQ ID NO: 182570 - DNA, 1686 bp, Homo sapiens
  Payload ID: 15970
  Gene Symbol: SNAI1
  Gene Name: snail family zinc finger 1
  Uniprot ID: O95863
  ENST ID: ENST00000244050
  CDS Start-End: 62-856
tagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaa

SEQ ID NO: 182571 - DNA, 2099 bp, Homo sapiens
  Payload ID: 15971
  Gene Symbol: SNAI2
  Gene Name: snail family zinc finger 2
  Uniprot ID: O43623
  ENST ID: ENST00000020945
  CDS Start-End: 176-982
aaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgtt

SEQ ID NO: 182572 - DNA, 2204 bp, Homo sapiens
  Payload ID: 15971
  Gene Symbol: SNAI2
  Gene Name: snail family zinc finger 2
  Uniprot ID: O43623
  ENST ID: ENST00000396822
  CDS Start-End: 359-1165
tctggaagccaggcgggcagggcagagaccccggctcctgcgcccctcctagctcccagagagcgtggatcgcgggcggggctcaccgagcgagctgtcccagagggaggagctgaaatctgaacctctcagctgtgattggatctttcttgcaaaagagaggaaaaaaaaaccctcccagccaaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaa

SEQ ID NO: 182573 - DNA, 1732 bp, Homo sapiens
  Payload ID: 15972
  Gene Symbol: SNAI3
  Gene Name: snail family zinc finger 3
  Uniprot ID: Q3KNW1
  ENST ID: ENST00000332281
  CDS Start-End: 88-966
cttcaagcgccggcggacgcagcagtccggacccaggcgcgcccctcccgccccagcccaccccggcctgccgcccgggaggggaacatgccgcgctccttcctggtgaaaacgcactccagccacagggtccccaactaccggcggctggagacgcagagagaaatcaatggtgcctgctctgcctgtggggggctggtggtgcccctcctcccccgagacaaggaggccccttctgtgcccggtgaccttccccagccctgggaccgctcctcggccgtcgcctgcatctccctgcccctcctgccacggatcgaggaagctctgggggcctctgggctggacgccttggaagtcagcgaggtcgaccctcgggccagccgggccgccattgtacccctcaaagacagcctgaaccacctcaacctgcccccactgctggtgctgcccacacggtggtccccgaccttgggcccagaccggcacggggctccggaaaaactgcttggggctgagcggatgccccgagccccgggcggctttgagtgcttccactgccacaaaccctaccacacgctggccgggctggccaggcaccggcagctgcactgccacctgcaggtggggcgtgtcttcacctgcaagtactgcgacaaggagtacaccagcctgggtgccctcaagatgcacatccgcactcacacgctgccctgcacctgcaagatctgtggcaaggccttctccaggccctggttactgcagggccatgtccgcacccacacaggggagaagccctatgcctgctcgcactgcagcagggcctttgccgaccgctccaaccttcgggcccatctgcaaacgcactcagacgccaagaagtaccggtgccggcgctgcaccaagaccttctcccgcatgtccctcctggcgcggcatgaggagtctggctgctgcccgggcccctgagaggcacgtggtcggcgcaggtaggagggatggtcctcaccgggagagctggcgtccctcctgcccccagaggagccaggagtctgggagggcggggcctggcctcacacttggtgcgtcctccacatctgcgtccaatcagaaccaaagaagtccagcgggggccactgggccggaggacactcccccaggcatcccaccgcgcggagcccactcagaggagactcctctcccggggaaggctttcatcagaacaagagccatggttccatttcgacacggccaggtctccggggctacccttccaagagtcagagcctcggggaggtggccgccagcatgggccggcactgccgccggatggctggcaaggctgcctagttccattgcagcagaaatgaacagttctgacttatagtgagcaccgccctgtggcccttcctcagtaggcacaactacctctcagccagcccccgccagcctttggtttggggtctgggacgagctgccccatgtcacacgtctatgtgcatgtgcacacacactcaaacatgtacacacacgtgccctccccacctcactagactctccgggagatggggcaggactgggagagcccacgattggtgatttgggtgtgttgggatgaggcggagtgcctgtgggatttgtcccggtcagagcctcagggggctggggtctcagggcactcagcttcccaggcaataacagccgtggggtaataaatggtctctgcacacctgca

SEQ ID NO: 182574 - DNA, 1030 bp, Homo sapiens
  Payload ID: 15973
  Gene Symbol: SNAPIN
  Gene Name: SNAP-associated protein
  Uniprot ID: O95295
  ENST ID: ENST00000368685
  CDS Start-End: 91-501
cgggcgccccctcacggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacgtgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatga

SEQ ID NO: 182575 - DNA, 5183 bp, Homo sapiens
  Payload ID: 15974
  Gene Symbol: SNRK
  Gene Name: SNF related kinase
  Uniprot ID: Q9NRH2
  ENST ID: ENST00000296088
  CDS Start-End: 305-2602
agctacccggcaccccctccccgcggccggcagcccgctcggtattatgattagcgctgggtgcggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgcttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaat

SEQ ID NO: 182576 - DNA, 2961 bp, Homo sapiens
  Payload ID: 15974
  Gene Symbol: SNRK
  Gene Name: SNF related kinase
  Uniprot ID: Q9NRH2
  ENST ID: ENST00000454177
  CDS Start-End: 383-2680
cacagtgacgcgcagcccgcgcaggcgcagctacccggcaccccctccccgcggccggcagcccgctcggtattatgattagcgctgggtgcggggtttcggcggccgggagggagttgtcggcgccgcggccgctgcggacggacgctcgcctgccggctgagagcctcctgagagtctgctttggcatccccagcatttggcctctgctcaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttat

SEQ ID NO: 182577 - DNA, 1995 bp, Homo sapiens
  Payload ID: 15974
  Gene Symbol: SNRK
  Gene Name: SNF related kinase
  ENST ID: ENST00000437827
  CDS Start-End: 120-1799
atgattagcgctgggtgcggggtttcggcggccgggagggagttgtcggcgccgcggccgctgcggacggacgctcgcctgccggctgagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccg

SEQ ID NO: 182578 - DNA, 5128 bp, Homo sapiens
  Payload ID: 15974
  Gene Symbol: SNRK
  Gene Name: SNF related kinase
  Uniprot ID: Q9NRH2
  ENST ID: ENST00000429705
  CDS Start-End: 245-2542
gcagctacccggcaccccctccccgcggccggcagcccgctcggtattatgattagcgctgggtgcggggtttcggcggccgggagggagttgtcggcgccgcggccgctgcggacggacgctcgcctgccggctgagatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgcttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaatataaa

SEQ ID NO: 182579 - DNA, 6649 bp, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENST ID: ENST00000275233
  CDS Start-End: 400-5451
gtctttggcctccgggaccagggagggaggacgctggttgtcctggagcccgggaagctcaagggctgagagggagccgctgcgcgagtcttccccacctcttcccgatcccggactagcgaacttcggaccaccacgtccctccggggataaagtggggtcgtgggaaaggaggctgtgcttctcctcatgcactggggcctgcggtgtttgtctcgagcgtccaacacactaggatccgggagtccgtcgtcacgctccttggcctcgcggtcgcttgtttgctcggcctgctgggagcgatccggcgctgacagccccgctcagactccgggagccgcttgtgggtctttcggaagataactgaagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcagg

SEQ ID NO: 182580 - DNA, 5237 bp, Homo sapiens
  Payload ID: 15975
  Gene Symbol: SHPRH
  Gene Name: SNF2 histone linker PHD RING helicase, E3 ubiquitin protein ligase
  ENST ID: ENST00000367503
  CDS Start-End: 300-2282
actcatgaagccagcgcaggagaaagggggcggggtgctctgacgagcgcgttcgccttgaccccacgctacagcgcgcgcccggcagctaggcgctgtggtttctgggtctcccgggggacccctacacgttccggcaaaaagcgctcgtgcccacctcaagcccatgttcggtgggtggcgaatgcgtgcccgtgatctgctgggtctgtagaggagcgcaggcctggtgcaaacagactcaagaggctcggagaaccagcttggagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaaggcaccatgacaatggaagagctgctgacatctttgcagaagaaatgtggaactgaatgtgaagaagcacatcgacagctagtttgtgctctcaatggcttagcaggcattcatattattaaaggtagaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaaggtattgtttctaagacatgctactttttcctatgctgcattatcataaaccactttagtgactcctttcataattaatggtgcaaattgttgtaattagtatttggtgttatatgagtcagaacactacctatgtctctacaatagcttcagagatcacaaaagaatattgtatctatagaaatttattatgcagatgatatagaaggcatgcactcgatagtagagaacaatgtaaatggactgtagttcaaagccttgaatagtaaaagtattaaaacatatctcggtgaaactggcataatgcaatttatacacatgcattcattcatcaatacaaaaatatgttgtaatttgttatttgaaactgaagtgtgtttcgaaagctactaaatcagagtacatggtaataaaggtagacttcaaatattaagtaattcaaaacacatgttctgagttatgatctgagtattatactggacactgatgaattggtgggtcattgattaaatataatttcattttattgcaggaatcatattttgctagttggcagagaaccttctaggggcaagatatagtagtaaatatttggatagggcaagtgaggacaagatatagatttgaattcttctggaaactggtataacatatacttaagtgaatcagtaaatctcagacaaaatgaaaagttagacattcattatagatatagcatggcgactaagaaggtagactttggaactggacagcccaattttgaatcgtgactcaactgttttctagatatgtgactttatttaagttattcacctttcctcgcatcatcagtaaaatgagaatgatgtcaacactactttatagtatagggctgtcttgaggattgtgtgaattaatacatgtaaaatgctagagtagtttctgatctattaagcactttctaggtttttgctgctattaatattattaagatcattattactgttatgattaccaacacttattctgaaag

SEQ ID NO: 182581 - DNA, 7201 bp, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENST ID: ENST00000367505
  CDS Start-End: 266-5317
gtgctctgacgagcgcgttcgccttgaccccacgctacagcgcgcgcccggcagctaggcgctgtggtttctgggtctcccgggggacccctacacgttccggcaaaaagcgctcgtgcccacctcaagcccatgttcggtgggtggcgaatgcgtgcccgtgatctgctgggtctgtagaggagcgcaggcctggtgcaaacagactcaagaggctcggagaaccagcttggagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtggaaatgaaaa

SEQ ID NO: 182582 - DNA, 468 bp, Homo sapiens
  Payload ID: 15975
  Gene Symbol: SHPRH
  Gene Name: SNF2 histone linker PHD RING helicase, E3 ubiquitin protein ligase
  ENST ID: ENST00000417762
  CDS Start-End: 1-390
attttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaaggttttttgaggaacaggcgttattttgttttcatgacatcaccccattctcccacccctggtccctgacaactgccattctacagttgagagatttggtgatttgtgagttgttttttatttactttaaaaattttttgatttgttttttatcatctttttcaatttagagatgttttgcacaagtaaaaattatggggcttattcagtaatacatgtctgtaaggaataaacattaagaaacccaa

SEQ ID NO: 182583 - DNA, 11660 bp, Homo sapiens
  Payload ID: 15975
  Gene Symbol: SHPRH
  Gene Name: SNF2 histone linker PHD RING helicase, E3 ubiquitin protein ligase
  ENST ID: ENST00000433355
  CDS Start-End: 1-1350
tggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctccatatccttttacatttagctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaaggtaaagtaggtcaggaacacatagaagcataggtaaggcaatataatataggaagcagtatctgattaagaaagcatgaacatcagaacaagcttgacagtgaataggtagacgccactgttgtctgtagatacactgcctgaaagcctcagcttaaccatgtaatttttaattgtaggaggaacacagaacacttattcaaacatggttagcgatagtcatgtacactgtgactaaaatgtaacatcttaaaattacagtttcctatcctctataatatttctatccaccacaagtagacagaggtctggttacattagagatttatttaaagaaagagttttcctcattcttttacacatccctgaatgtaaggaaaaaaggatgtgtctaactaaacagaaggataaaataaattggctaatgaagacagctacaagaaagagggtaatgtgctttttaaacagcatagattgatattccaggataaagccaaattttggctttattttcctaatttttttccatgcttcattcagaattttaagaaaattactataatgtgatatccagactggatctgtaattggatttactgcttttaaggggtatttaataaaaagccaagactattttgctctttcttttccttaaatatgcttttttaatattttttttctaaccaaacttgaacaaaggacacatcggtatctaaatttagtagcaaatgtgggctttaaggaatagagaatgagaattagagaatgatggggttgactcttaagcaagatgaagtattctttattaattccttctgagtttttgatactcctcacttttaagtaatgtgttttttaagtagaatcagctacaagttgaaattcactaccagtagttaagcagttattagggtacccttctcccaagaaaactgtagctgcattaaagaacttttaattgctcttttttcactgttatttgagtaaaacctgaaaatatcagttatattgctctttagtctgttgggataaacagaattccacagttagaataagcattcatccattcattccacacatatatattggacacgtactagcacacaggcagtgtgctaggcctcatagacacagcatacacataaataaaacagatatggttactacttttgtggagattggtgaaggagtttgagttggggcaggaagcacagatgttaataaataatgtgttataattgtgataagcactacaaaagaacaaagctggaggcatcatgctacctgatttcaaactatactacaaggctacagtaaccaaaacagaatggtaccaaaacagacatataggcgaatggagcagaacagagacctcagaaataataccacacatctacaactgatctttgacagacccgacaaaaacaaacaatggggaaaggatcctattgggtaaatggggctggaaaaactggctagccatatgcagaaaactgaaaccggaccccttccttacaccttacacaaaaattaactcaagatagattaaagacttaaatgtaaaacccaaaaccctaaaaatccgagaagaaaacctaggcagtaccattcaggacgtaggcatggacaaagacttcatgacaaaaatgccaaaagcaattgcaacaaaagccaaaattgacaaagggaatctaattaaagagcttctgcagagcaaaagaaattatcgtcggtaaacaggcatcctacagaacgggagaaaatttttgcaatcaacccatctgacagaggtctaatatccagaatttacaaggaatgtgaacatatttataagaaaaaaacaaccccatcaaaaattggacaaaggacatgaacagacacttctcaaaagaagatatttacgtggccaacaaacatgaaaaaaagttcatcactgatcatcggagaaatgcaaatcagaaccacaatgagataccatctcacaccagtcagaatggcgattattaaaaagtcaacaaacaatagatgctggcaaggctgtgaagaaataggaacgtttttacactgttggtaggaatataaattagtgcaaccattgtggaagacagtatggcgattcctcaaggatctagaaacagaaatcccataggacccagcaatcccattactgcatatatacccaaaggaatataaatcattctgctataaagacatatacacacaaatgtttactgcagcactatttacaataacaaatatatggaaccaatccaaatgcccatcaatgatagactagataaagaaaatatagtacatatgcaccatgtaatactatgcatccataaaaaggaatgagatcatgtcctttgcagggacatggatgaagctggaagccatcatcctcagcaaactaacacaggaacaaaaaaccaccacatgttctcactcgtaagtgggagttgaacactgagaacacatggacacaaagaagggaacaacacacacaccagggcttgttggggcaggggagtaaggagagggaactaagagggcagataaataggtgcagcaaactaccatggcacatggatacctgtgtaacaagcctgcatattctgtacatgtatcctgtttttttgttttgttttgttttgttttgttttttaaggagaaaaaggaaaaaaagtctctgagggaatgacagttaagcaggtatctaaaggatgaatgatgaattagtcagcctgaggagagaataggttggctcccagacagagaaaaagaaaaccagaagagagccagtgcatggaaaagcctaagacaaggactcaaatggatctgagtggctgaagtgtagaaagcaaggagaaagcagttgaataagcctggagacctaactaggggaccagatgttgaagggccacctgaacatttgagaattttatttttatttaaggagaaagccattaaatattataagcagggatgtatcatgatcaaatttggatttcaaaaagatctctcttgtgtggaaaacagatgatgaggaacagaatagagcagaagaaatttggagagagcagcttaggaggctacagcaggagtaatggtggctttgatttggctgatggcggtagaaatggagagaagtgggtatattctagacatgtttagaataaagttagagaatgttggcagcattagtgaaggaaatttcatagatcacccctggtttctgatgtgaataagcaggtgggtaatggtatagctaatgatacaagatatttggaagaggaatacatttagacatatcatatttaaggtgcctaagacatccaagtagaactatccagaaaagtgttgatatgtggagctggagatacaaaattcggagtcactaatagaaaagtttgcttcagattgagtcctatgaagtccataactttaaaagattgaatcaagttgggagggctggaaaatgagaaggagcaactagggacaggcaatccaggcaggtacgctggcaacaaagaccacagggaagctctgcttcggtgaggagacagtagtgctgaaggtggatcaactacaatgtggactaatttgtctaatgaggtcactgatgactttagaaggagctcttttaatacaaatgtagaggcagaaagcagattgggagggattgcgggatgagcaggaagtcaacaagtagaaaaaatgcccaactgtttcataaacttaactgtgagatagaatcagaattgtaaccagaacctatgaaaacagaaagacatcacttttttgttgttgttctgtttaagacaaaagattcttgagcatgtttagtctccagtgaaaaaaggatagactgaagatataggagaaaggataatttgtaatacaagtttcttgaaaagaaggagaatgttgatgtatagaaagtagagtttcattgaagtcaaataacaggtataaattgggctattgagcacaaaagatataagcataggtgttcttatctgagaatgggagatcatagtcattccagagaggacaggcctgccagatgtgactgtagaagtaggtgactcaagtgaggtggagaagaaaagatgctagaagatgaaacagtgagacctgaattttggatgagctgtccaagcagacagtatgtaatatctagagttgaggtatagagtaaattaggcaccaaagttctttagtgaatgtagggtagggttcaataaattatagcaaagggtagagttgggataactgggcttcagggggctcaaaaaatggaagttgttacacaaatgagaactaatgctctgaaacctgcatttgtggaccagcactcaaatgcaacagtcaaatccttcactcaaaagggctgctgagagaccagtatgcttagaagatagccaggttctaattaaagcagggaagtgaagagcagtatttctacaagaggtagaaaatatgaaacaatttgtttcataaaatacgggttccagggggcgccagtgaaaggtccaggagtgaaaggagaaaaattagagggtaaacaagcaggaaggaagtgcaggacagtatgggaataacagaacaggcaaggatacgtgatgagagcatcatgacctaaggatcatctagtcctgttccctctctgtgaatcccctgaatacattttacagtcagccctgtgtatctgtggatatagccaaccatagatcaaaaatacttggaaaaagaaaaattccatgaagttctaaagagcagaacttgaatttgcagcatgctgagtttacattgaatccacgcaaatgcaatgatgtgtagggattatatgaggtaatctagagatgatttaaagtatacaggaggatgtgtgtatgttatatgcaaatatgacatcattttatataagggccttgagcatcctgggattttggtatccacaggggttttggaagcagtcagtccctcacagatactgagggaggactatatttttaaagcaaataccaaagagttattgaaggaagaagtaggtgacttatggtgcagccctgaggcatttgacagttattctttatcctgcctgcacttaggagctatgctgcttcccagtccctctctccctttcttcccactcctatagtttctcctttcctttccataaagatagtctttcttagcccttccttttttctcttctttctcttcctctggccacagcatctcaagggccacagatggcctttgtggctaagaagaggtggctcacccttaggtgacagcatgcatcacagtacaaggaactggcataagaaagaactgctgtgtcaggttttgcgcagagaggttaaggaagtgattgctctagctactggtaaacagcacagcctctacgaaactgagtcattgagcccatcaaatccaaacacctgttcattttatggcagctttcctagacacccaggatagagattggcacagttacatgtgctgtgctgttggagcagggatatcggtatataaatactgtttattgtgctctcacttctcgctgtctttcatgagtattgattaacacgtgaattaactgaagcatcttttaaaaaaaattaagtttatagaatttactaaagataatttccctttttatcatagatgcacatgtaattacatttccttttcttaaacataagactattgtaccattgtgcgggcaaattttatccctcctcgacgttgtcacactgcttcacgccatgtttaggttggctcttcactgctttttctgttaccatttgtgtctgccacatttgccttgtgcttcctgtctcttcttctgacttctgtcacatttctggcctgctgtctgtcacttcctccttgaaacatcagcttattgtattctgagacttcacccctctcttgtgactctttgaaacttccacataaatgatcatattgcctattttggattagtatgtaaataaagatggctttgtgtaaataattaaggcattattttcaaattttagaaactactagttccaattatttctaaacctagtttttttctttatattactgttgattatcaaatcgttgttctttaacaagcaatactgacaagtaattttttatttaattgaaatgtttatattatctgaaatataaaatttatttctgaaatgattatttcactgtatttatgtcaagattctcagacatagcaaaccatatatcgtacagaatgcttaatcatatagcttttttgtggataaaagatatttggaaagcataaaactattatttattagtagtagacatttttaagtagtatttcttggaaataagagattttacaatgtaaggaatgctgttgattgaccatagatataaaatgaatactgggatcacaaatgtcctgttcggtggatgcacttaagttgaagaccatttcttccctagcaacagtgtgatggtattcctaaatgacctttggaacctactgggcatctcacaaagtaaacaaaattccccttgcaagttctgacaactgccaggcattttggatggtgaagtaggcctcctggcagaacatatggcccacatgtcttgttccctgtgtcttacatttggctaggttttatacaaagcattttgccagtggaaaccctgaccctatatactggtcaagagtcttagataataagaaatttctgtccgggagaaaatagatacagccactacatagatatagtgacagcaatacagtacccttcccacccaccacatgctacacaattgctttttttgtcaaacttttaagtatgtgaccatcaactggcctgctttttaaaataaatatttttgttcaggctctgtctccataaactttgactcattagacctgggatgtggtccagaaatctgcatttttagcaagcatatctcttgataatagagatatcttatacagcctttttgtagagaaaaaaactctgtatctctacattccaactcacagagaagcctagccatactatgtgtagaattctacatgtggaattctattctgttttttttttatttgaatttttgttcatttaatttaaagatcatttgtgacatctgtctcacacttttaaaatataattaaaataaacatctgagtg

SEQ ID NO: 182584 - DNA, 6994 bp, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENST ID: ENST00000438092
  CDS Start-End: 400-5379
gtctttggcctccgggaccagggagggaggacgctggttgtcctggagcccgggaagctcaagggctgagagggagccgctgcgcgagtcttccccacctcttcccgatcccggactagcgaacttcggaccaccacgtccctccggggataaagtggggtcgtgggaaaggaggctgtgcttctcctcatgcactggggcctgcggtgtttgtctcgagcgtccaacacactaggatccgggagtccgtcgtcacgctccttggcctcgcggtcgcttgtttgctcggcctgctgggagcgatccggcgctgacagccccgctcagactccgggagccgcttgtgggtctttcggaagataactgaagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagttttgaacagtctaccttttcttttagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaaaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtggaaa

SEQ ID NO: 182585 - DNA, 927 bp, Homo sapiens
  Payload ID: 15975
  Gene Symbol: SHPRH
  Gene Name: SNF2 histone linker PHD RING helicase, E3 ubiquitin protein ligase
  ENST ID: ENST00000521977
  CDS Start-End: 1-292
gaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagacgttgcatctttggtcaggactgcagattcagagttgtctgccattggtcaccttgggagagtgtggatggcttggtgcagctcatcaacactactggaaaaacagcccaaattctccaagttctgctcatgatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagt

SEQ ID NO: 182586 - DNA, 5245 bp, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENST ID: ENST00000519632
  CDS Start-End: 300-3089
actcatgaagccagcgcaggagaaagggggcggggtgctctgacgagcgcgttcgccttgaccccacgctacagcgcgcgcccggcagctaggcgctgtggtttctgggtctcccgggggacccctacacgttccggcaaaaagcgctcgtgcccacctcaagcccatgttcggtgggtggcgaatgcgtgcccgtgatctgctgggtctgtagaggagcgcaggcctggtgcaaacagactcaagaggctcggagaaccagcttggagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagcaccatgacaatggaagagctgctgacatctttgcagaagaaatgtggaactgaatgtgaagaagcacatcgacagctagtttgtgctctcaatggcttagcaggcattcatattattaaaggtagaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaaggtattgtttctaagacatgctactttttcctatgctgcattatcataaaccactttagtgactcctttcataattaatggtgcaaattgttgtaattagtatttggtgttatatgagtcagaacactacctatgtctctacaatagcttcagagatcacaaaagaatattgtatctatagaaatttattatgcagatgatatagaaggcatgcactcgatagtagagaacaatgtaaatggactgtagttcaaagccttgaatagtaaaagtattaaaacatatctcggtgaaactggcataatgcaatttatacacatgcattcattcatcaatacaaaaatatgttgtaatttgttatttgaaactgaagtgtgtttcgaaagctactaaatcagagtacatggtaataaaggtagacttcaaatattaagtaattcaaaacacatgttctgagttatgatctgagtattatactggacactgatgaattggtgggtcattgattaaatataatttcattttattgcaggaatcatattttgctagttggcagagaaccttctaggggcaagatatagtagtaaatatttggatagggcaagtgaggacaagatatagatttgaattcttctggaaactggtataacatatacttaagtgaatcagtaaatctcagacaaaatgaaaagttagacattcattatagatatagcatggcgactaagaaggtagactttggaactggacagcccaattttgaatcgtgactcaactgttttctagatatgtgactttatttaagttattcacctttcctcgcatcatcagtaaaatgagaatgatgtcaacactactttatagtatagggctgtcttgaggattgtgtgaattaatacatgtaaaatgctagagtagtttctgatctattaagcactttctaggtttttgctgctattaatattattaagatcattattactgttatgattaccaacacttattctgaaagataaaaa

SEQ ID NO: 182587 - DNA, 7338 bp, Homo sapiens
  Payload ID: 15975
  Gene Symbol: SHPRH
  Gene Name: SNF2 histone linker PHD RING helicase, E3 ubiquitin protein ligase
  ENST ID: ENST00000629427
  CDS Start-End: 400-5463
gtctttggcctccgggaccagggagggaggacgctggttgtcctggagcccgggaagctcaagggctgagagggagccgctgcgcgagtcttccccacctcttcccgatcccggactagcgaacttcggaccaccacgtccctccggggataaagtggggtcgtgggaaaggaggctgtgcttctcctcatgcactggggcctgcggtgtttgtctcgagcgtccaacacactaggatccgggagtccgtcgtcacgctccttggcctcgcggtcgcttgtttgctcggcctgctgggagcgatccggcgctgacagccccgctcagactccgggagccgcttgtgggtctttcggaagataactgaagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagttttgaacagtctaccttttcttttagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaaaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtgg

SEQ ID NO: 182588 - DNA, 11754 bp, Homo sapiens
  Payload ID: 15976
  Gene Symbol: SRCAP
  Gene Name: Snf2-related CREBBP activator protein
  Uniprot ID: Q6ZRS2
  ENST ID: ENST00000262518
  CDS Start-End: 386-10078
aacttgggcagaggtcaggggtcacgcgaggtcagtccgtcgggagggctagggagatggtcacgaaacctgaagtcaagagttaaggcttgttggcttctggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaaggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccaggtgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtaagagccctgttcatttttacattctctgttcactccctgggccctccttgtgtcctcctgttgactctgtgcttacctcatctgagttatttctttgtatctacttccctgcagcttcttggcacacatcattctttgctctctacttgtctcgcccctttcacctttcctatccttcgttacttgggttcagggagccaaggtggtttcattttgtctgggttgtaggggaatggttggagataagggtagaaaggtggtttgatgccagggcctagaggacctgagaagtagggagacaagaaatgattaagtagggcatcattttgcaggtttctgtgtggtaatgaggtcatttagactcagtgtactagtctgattgtgttatgtggcctgggttaaattggagagaggaggtggcagggaggcagcatagcagaggaagccctgacttagggaagtaaagtctttctgatgtttggttttagtggtaataaagggcttacttgggtacattttccttacctttctccattcccataactgttttcatgtaaaatggctgctttgcttgaaacgggttgcagtacctagggtcctgctctctgacatctataatactcagggggcagcctcttgggaatttgggggaattgtagagtcctttgaaatacagattaaaataacagattcatagca

SEQ ID NO: 182589 - DNA, 9126 bp, Homo sapiens
  Payload ID: 15976
  Gene Symbol: SRCAP
  Gene Name: Snf2-related CREBBP activator protein
  ENST ID: ENST00000395059
  CDS Start-End: 211-9126
ccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtga

SEQ ID NO: 182590 - DNA, 836 bp, Homo sapiens
  Payload ID: 15976
  Gene Symbol: SRCAP
  Gene Name: Snf2-related CREBBP activator protein
  ENST ID: ENST00000411466
  CDS Start-End: 537-836
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggcc

SEQ ID NO: 182591 - DNA, 5937 bp, Homo sapiens
  Payload ID: 15976
  Gene Symbol: SRCAP
  Gene Name: Snf2-related CREBBP activator protein
  ENST ID: ENST00000483083
  CDS Start-End: 1-4832
aaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacggtggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaaggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccaggtgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggtaagttttacttcctcaagagggaacaggaagttgagtttctttggagtgttggtagggtggatggaacagtgatgtcacatttaacctggtgaattacaaagcttaatgttatggaccaagtacttgagtgacatttggacaagtcccttctcttccctgggcgtgtacctcatgatccgcctgcctcagcctcctgaagtgttaggattacaggggtgagccaccacgcccggcctcttttcccgttttttaacccgcacggtaataaatgggcagtaaaaggaactcttctctgtcccttttatgatttccggtagctgtttctttcctgtactatgtatataggcccatgtctgtgtagtacttgagttaaactcacagttcagcttaagtaaaccagaactaaggagaaggaaggtccagtgggtccctccacgccctctggcttttccccactgtaatcagagctgctgcttagtctttgcttcatgcctactcccccaccttccaccagtgccattgactccacctttggtttttacctgaccagccgctaggttggtcctggctggttggaagtagagagtagagggattgctctgcaagtagataatagcctcttgccacttggttttttttggtaacagtttgtgctataaatcatataccattcgatttacccatttaaactgtacaatagtttttggttttttttttaaatacagatgggggtctcccactcttgaccaggctggtctcgaattcctggcctcaagtgatcctcccatctcggcctcccaaaatgctgggattataggtgtgagccaccatgcctggccctaaactgtacaataggtttttaatatatttatagggttgtacaatcatcaacacaatcaacttagaacctttccgtggccccaaaaagaaacgctgcacctgttagccagcattccccaatccctccgtccctcctagtcttgaatgactaccatcctacttttttatttctctagttttgcctatggagtcataatgtataatgtgtggtccattgtgactggcatcttctacttagattaatgttctttgaattttattgtgttatagcgtatatcagtacttcatttgtttttatgttgaataataatgtatgaataccacattttatccttga

SEQ ID NO: 182592 - DNA, 951 bp, Homo sapiens
  Payload ID: 15977
  Gene Symbol: SNF8
  Gene Name: SNF8, ESCRT-II complex subunit
  Uniprot ID: Q96H20
  ENST ID: ENST00000290330
  CDS Start-End: 77-850
gggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaa

SEQ ID NO: 182593 - DNA, 2319 bp, Homo sapiens
  Payload ID: 15977
  Gene Symbol: SNF8
  Gene Name: SNF8, ESCRT-II complex subunit
  Uniprot ID: Q96H20
  ENST ID: ENST00000502492
  CDS Start-End: 384-1160
atttgatgacctccaggcagtggagaggcagtcgaggaagaccagggccccaggcgcctacgtgggtggaatgcacaaggttggccttggctgccggggctccatgtcccagcactagccaaggagggcctcagccgcgcttgaatactcgtgctttcctcgccgcgaggctttgcgaatcttggccactagctaaaggcggggtcgccgggccggtaggaactggagacactcagcctcgcggcaggaaatgcggctcgtggcttccggcgcgtgcagatgacgcgcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagcaagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctgga

SEQ ID NO: 182594 - DNA, 1051 bp, Homo sapiens
  Payload ID: 15977
  Gene Symbol: SNF8
  Gene Name: SNF8, ESCRT-II complex subunit
  ENST ID: ENST00000510558
  CDS Start-End: 73-576
gccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagctggagcgcagtggtacaatctcggctcactgcaacctccgcctcctgggttcaaatgattcttctgcctcagcctcctgagtagctgggattacagagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtt

SEQ ID NO: 182595 - DNA, 560 bp, Homo sapiens
  Payload ID: 15977
  Gene Symbol: SNF8
  Gene Name: SNF8, ESCRT-II complex subunit
  ENST ID: ENST00000509995
  CDS Start-End: 1-245
tgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtt

SEQ ID NO: 182596 - DNA, 742 bp, Homo sapiens
  Payload ID: 15977
  Gene Symbol: SNF8
  Gene Name: SNF8, ESCRT-II complex subunit
  ENST ID: ENST00000507302
  CDS Start-End: 14-325
gcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctcaggagttaccctggaaaaggattttggtctgagatgctgggcgtgggggacttctattacgaactaggtgtccaaattatcgaagtgtgcctggcgctgaagcatcggaatggagtctacaggcctctaaggacttgagagacatcttagctgtttcatgcagttgaatccatggcaagtctccatggccaagggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctg

SEQ ID NO: 182597 - DNA, 775 bp, Homo sapiens
  Payload ID: 15977
  Gene Symbol: SNF8
  Gene Name: SNF8, ESCRT-II complex subunit
  ENST ID: ENST00000514929
  CDS Start-End: 98-523
gcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagtaggtcttgtcttccaatcccttggagtacagaaagagagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctg

SEQ ID NO: 182598 - DNA, 700 bp, Homo sapiens
  Payload ID: 15977
  Gene Symbol: SNF8
  Gene Name: SNF8, ESCRT-II complex subunit
  ENST ID: ENST00000576353
  CDS Start-End: 92-253
cgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacag

SEQ ID NO: 182599 - DNA, 583 bp, Homo sapiens
  Payload ID: 15977
  Gene Symbol: SNF8
  Gene Name: SNF8, ESCRT-II complex subunit
  ENST ID: ENST00000573795
  CDS Start-End: 78-188
ggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggagg

SEQ ID NO: 182600 - DNA, 677 bp, Homo sapiens
  Payload ID: 15977
  Gene Symbol: SNF8
  Gene Name: SNF8, ESCRT-II complex subunit
  ENST ID: ENST00000509989
  CDS Start-End: 1-49
cgaagtgtgcctggcgctgaagcatcggaatggaggtgagggtggctaggtcctgtgaactggactctggacttctctgagagggagaaaaccgtaaaagattatcgtttccatcctgcagtctacaggcctctaaggacttgagagacatcttagctgtttcatgcagttgaatccatggcaagtctccatggccaagggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtgg

SEQ ID NO: 182601 - DNA, 331 bp, Homo sapiens
  Payload ID: 15978
  Gene Symbol: SNURF
  Gene Name: SNRPN upstream reading frame
  Uniprot ID: Q9Y675
  ENST ID: ENST00000338327
  CDS Start-End: 36-251
ctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagacaatgtaataaaaatattattcataatttttcaa

SEQ ID NO: 182602 - DNA, 650 bp, Homo sapiens
  Payload ID: 15978
  Gene Symbol: SNURF
  Gene Name: SNRPN upstream reading frame
  Uniprot ID: Q9Y675
  ENST ID: ENST00000577949
  CDS Start-End: 64-279
cgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtg

SEQ ID NO: 182603 - DNA, 796 bp, Homo sapiens
  Payload ID: 15978
  Gene Symbol: SNURF
  Gene Name: SNRPN upstream reading frame
  Uniprot ID: Q9Y675
  ENST ID: ENST00000580062
  CDS Start-End: 46-261
ccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccc

SEQ ID NO: 182604 - DNA, 1325 bp, Homo sapiens
  Payload ID: 15979
  Gene Symbol:
  Gene Name: SNRPN upstream reading frame protein  [Source:UniProtKB/Swiss-Prot
  Acc:Q9Y675]
  Uniprot ID: Q9Y675
  ENST ID: ENST00000551312
  CDS Start-End: 16-231
gcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagcaatcaggatgagtgaaaaattgatttgcagctgacctgcaaatggaatcatcaggaacatccctttctcatggagtcccttaatttacaagttaactgcaaacataggagatgatagttccaagaaggaacattttatc

SEQ ID NO: 182605 - DNA, 669 bp, Homo sapiens
  Payload ID: 15979
  Gene Symbol:
  Gene Name: SNRPN upstream reading frame protein  [Source:UniProtKB/Swiss-Prot
  Acc:Q9Y675]
  ENST ID: ENST00000557230
  CDS Start-End: 16-129
gcggtcagtgacgcgatggagcgggcaagggatcgcttacacctgagacgaactacagaacagcacgtaccagaggtggaagtccaagtcaaacgcagaaggactgcctcactgagcaaccaagagtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggggaagcatttctccttgcattggtttgctggtatggatggcccttagattttggcatgagtgattatgcagcctatttgaagaaaacctgttttcaggacctttttaattaaatatggcctgttacatgagttaaaggcaatcaggatgagtgaaaaattgatttgcagctgacctgcaaatggaatcatcaggaacatccctttctcatggagtcccttaatttacaagttaactgcaaacataggagatgatagttccaagaaggaacattttatc

SEQ ID NO: 182606 - DNA, 1630 bp, Homo sapiens
  Payload ID: 15980
  Gene Symbol: SNU13
  Gene Name: SNU13 homolog, small nuclear ribonucleoprotein (U4/U6.U5)
  Uniprot ID: P55769
  ENST ID: ENST00000215956
  CDS Start-End: 265-651
gagaactcctccatccttcacctaattcttcctagttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataa

SEQ ID NO: 182607 - DNA, 1503 bp, Homo sapiens
  Payload ID: 15980
  Gene Symbol: SNU13
  Gene Name: SNU13 homolog, small nuclear ribonucleoprotein (U4/U6.U5)
  Uniprot ID: P55769
  ENST ID: ENST00000355257
  CDS Start-End: 114-500
gccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacagaa

SEQ ID NO: 182608 - DNA, 1670 bp, Homo sapiens
  Payload ID: 15980
  Gene Symbol: SNU13
  Gene Name: SNU13 homolog, small nuclear ribonucleoprotein (U4/U6.U5)
  Uniprot ID: P55769
  ENST ID: ENST00000401959
  CDS Start-End: 318-704
tctgtgagtttttccggtgcacgcgagtgcttctgaaacgtcagctgcgctcccctaggagtgctgagcccgcggaaccgcagccatgttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtg

SEQ ID NO: 182609 - DNA, 462 bp, Homo sapiens
  Payload ID: 15980
  Gene Symbol: SNU13
  Gene Name: SNU13 homolog, small nuclear ribonucleoprotein (U4/U6.U5)
  ENST ID: ENST00000402458
  CDS Start-End: 56-454
aaagggggctgatgccccagcctcaactctgaccctggtgccaggcctggttagcatgctcttggtgcagactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtgg

SEQ ID NO: 182610 - DNA, 1513 bp, Homo sapiens
  Payload ID: 15981
  Gene Symbol: SNUPN
  Gene Name: snurportin 1
  Uniprot ID: O95149
  ENST ID: ENST00000308588
  CDS Start-End: 156-1238
agggaggagccggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 182611 - DNA, 1931 bp, Homo sapiens
  Payload ID: 15981
  Gene Symbol: SNUPN
  Gene Name: snurportin 1
  Uniprot ID: O95149
  ENST ID: ENST00000564644
  CDS Start-End: 580-1662
gtgcgacggtcacctcggtttgggtgagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggccgggcgttgtggcgcgtgcctgtaatcccagctactcgggaggctgaggcaggagaatcgcttgaatccgggagatggaggttgcagtgagccgagatcatgccactgcactccagcctgggcaacaagagcgaaactctgtctcaaaaaaaaaacaacaacaacaaagaaaaaacaaaacgaaacagcaggaacccgccaagaacagccttgaaggaagggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaag

SEQ ID NO: 182612 - DNA, 406 bp, Homo sapiens
  Payload ID: 15981
  Gene Symbol: SNUPN
  Gene Name: snurportin 1
  ENST ID: ENST00000563875
  CDS Start-End: 401-406
gagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggttcttcacactactggagcattgacgttacttgttaagcagccttccacatcctagctcttttccaaggaagatggaa

SEQ ID NO: 182613 - DNA, 661 bp, Homo sapiens
  Payload ID: 15981
  Gene Symbol: SNUPN
  Gene Name: snurportin 1
  ENST ID: ENST00000563793
  CDS Start-End: 471-661
agggagttggagcgggggttactggtgctaagaccacctggggctaaggtccgaacacttggaggcagcaccatccaaggaatgggttgaaacagcaggagcccggcggggcgcagtggctcacgcctgtaatcccagcactttgggaggccgaggtgggcggatcacctgaggtcaggagtttgagaccagcctgaccaacatggtgaaaccccatctgtactaaaaatacaaaaaaaattagccgggcgttgtggcgcgtgcctgtaatcccagctactcgggaggctgaggcaggagaatcgcttgaatccgggagatggaggttgcagtgagccgagatcatgccactgcactccagcctgggcaacaagagcgaaactctgtctcaaaaaaaaaacaacaacaacaaagaaaaaacaaaacgaaacagcaggaacccgccaagaacagccttgaaggaagggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaag

SEQ ID NO: 182614 - DNA, 1641 bp, Homo sapiens
  Payload ID: 15981
  Gene Symbol: SNUPN
  Gene Name: snurportin 1
  Uniprot ID: O95149
  ENST ID: ENST00000567134
  CDS Start-End: 284-1366
ggcgcgaggcctgtgggcccagcggtgaggcagcagctgggggcggggggagggcggacctagcttcccagggcaggtgattcgtcggccccggtggcggcggcgcgtgcgacggtcacctcggtttggggtccacctaaagtgggaagtctgttttcaaaatgacatctactccatgcctgtcttgtttccctaatgtactttatggaagttcttcacactactggagcattgacgttacttgttaagcagccttccacatcctagctcttttccaaggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 182615 - DNA, 1023 bp, Homo sapiens
  Payload ID: 15981
  Gene Symbol: SNUPN
  Gene Name: snurportin 1
  ENST ID: ENST00000569817
  CDS Start-End: 395-1023
gtaatccaggcaattggcactgcccgtttaagagcacgggcccaagaggggaaggggactccaggtgaagccctaaggcccgggaagatctgcgggaggcggcagggcccagggcgttgaatgcccggccacaagatcagcctcctcccattggcgaaaggagccccgaagagcttgtgttcaggagggaggcctcggcctggtcaagtcatctagcaggaagagtcccggacagtgcaaagcaaatgcaagaagaccccctccctagccgatgggaaatgccccagccgttgaaggcggaaataacggcctgtaggcaacggaactcccagcgttcgcaaaggagggaggagccggaaactcagggcgcgaggcctgtgggcccagcgggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattc

SEQ ID NO: 182616 - DNA, 644 bp, Homo sapiens
  Payload ID: 15981
  Gene Symbol: SNUPN
  Gene Name: snurportin 1
  ENST ID: ENST00000564086
  CDS Start-End: 237-644
cccgccctgcagaggctacaccctggcaggacttaatctcctaaatctctgccgcttaccctagtcttttgcaccaatttaatcattccttcacgcagggtctactgagcgccatcccttgtgctggactctggctacttaaataggaatcaagccaggtccctaccattgctcagcccgcagccgagtgggaaagaagctcgcaaaagcagcaaacaggcagtaatcgagggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccagg

SEQ ID NO: 182617 - DNA, 759 bp, Homo sapiens
  Payload ID: 15981
  Gene Symbol: SNUPN
  Gene Name: snurportin 1
  ENST ID: ENST00000568162
  CDS Start-End: 458-759
ccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggggtccacctaaagtgggaagtctgttttcaaaatgacatctactccatgcctgtcttgtttccctaatgtactttatggaagttcttcacactactggagcattgacgttacttgttaagcagccttccacatcctagctcttttccaaggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatca

SEQ ID NO: 182618 - DNA, 920 bp, Homo sapiens
  Payload ID: 15981
  Gene Symbol: SNUPN
  Gene Name: snurportin 1
  ENST ID: ENST00000568078
  CDS Start-End: 1-603
agaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtaacgaaaccattgtctttattgccttgacatgatgataggctgcagagagacttagttacacaaagtcttaaaatattccttgattgtgctgtgtcaaagcatcagaatgggacaaagctgattctggagaaaggatgtacttgctgcccttcagagcctgagctccacccatgctggataagtcagaatgctggcactggaagggcccttaatggacagctcgtccaactccctcatcttacagatggagaaactgaggtccggagaaactgaggcccagataggagcaagacttgcatgcctagatccttcttgtgtgcctcttcctactgcaagctgagacc

SEQ ID NO: 182619 - DNA, 1682 bp, Homo sapiens
  Payload ID: 15981
  Gene Symbol: SNUPN
  Gene Name: snurportin 1
  Uniprot ID: O95149
  ENST ID: ENST00000564675
  CDS Start-End: 364-1446
ggcgcgtgcgacggtcacctcggtttgggtgagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatccc

SEQ ID NO: 182620 - DNA, 2163 bp, Homo sapiens
  Payload ID: 15982
  Gene Symbol: SNW1
  Gene Name: SNW domain containing 1
  Uniprot ID: Q13573
  ENST ID: ENST00000261531
  CDS Start-End: 64-1674
cctcatcatctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaa

SEQ ID NO: 182621 - DNA, 1855 bp, Homo sapiens
  Payload ID: 15982
  Gene Symbol: SNW1
  Gene Name: SNW domain containing 1
  ENST ID: ENST00000555761
  CDS Start-End: 30-1745
gtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacaggtgccaagccatacaactcaatttcagtgtttacactggtgaaagcaaagtagttcatagttttttctccttttccttagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactg

SEQ ID NO: 182622 - DNA, 1966 bp, Homo sapiens
  Payload ID: 15982
  Gene Symbol: SNW1
  Gene Name: SNW domain containing 1
  ENST ID: ENST00000556428
  CDS Start-End: 81-224
actccttcctttccgctcctcatcatctggaaagacccgcccagcggtgctgtcgctcgcgctggaagaagcggaagaagatggcgctcaccagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggtt

SEQ ID NO: 182623 - DNA, 1687 bp, Homo sapiens
  Payload ID: 15982
  Gene Symbol: SNW1
  Gene Name: SNW domain containing 1
  ENST ID: ENST00000554775
  CDS Start-End: 103-1227
tcgctcgcgctggaagaagcggaagaagatggcgctcaccagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactat

SEQ ID NO: 182624 - DNA, 584 bp, Homo sapiens
  Payload ID: 15982
  Gene Symbol: SNW1
  Gene Name: SNW domain containing 1
  ENST ID: ENST00000554324
  CDS Start-End: 30-584
gtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagatgactgtaaaggaacaacaagagtggaagattcctccttgtatttctaactggaaaaatgcaaagggttatacaattccattagacaaacgtctggctgctgatggaagaggactacagacagtacac

SEQ ID NO: 182625 - DNA, 3055 bp, Homo sapiens
  Payload ID: 15983
  Gene Symbol: SCLT1
  Gene Name: sodium channel and clathrin linker 1
  Uniprot ID: Q96NL6
  ENST ID: ENST00000281142
  CDS Start-End: 505-2571
aagaggcgccaccgtctccaaggagtggtccggggcaccggtttcaaagtcgcagggcgggccgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggttgcacagtgaattaaaagatgctgttgaaaaaaaattggaggcctttcccctgggcacagaggtaggaactgacatatatgcagatgatgaaacagtcagaaaccttcaagaacaattgcagctagccaatcaagaaaaaactcaggctgtggaactctggcagactgtttctcaggagttggacagactacacaagctttaccaggaacatatgactgaggcccagattcatgtatttgaaagtcaaaaacaaaaggatcagctatttgattttcaacaactgaccaaacaacttcatgttactaatgagaacatggaagtgactaaccaacagtttctgaaaacagtaactgaacaaagtgtgataatcgaacaactccgaaaaaaacttaggcaagccaaattagagctgagagttgctgtagcaaaagtggaagagttaactaatgtgactgaagatctgcagggacagatgaaaaagaaggagaaggatgtggtgtctgcccatggaagagaggaagcatcagataggcgtttacagcagttacagtctagtataaaacaattagaaataagattatgtgtgacaatccaagaagccaaccaattaagaaccgaaaatacacatctggaaaaacagaccagagagctacaagcaaagtgcaatgaattagaaaatgagagatatgaggctattgtaagagccagaaatagcatgcaactcttagaagaagctaaccttcaaaaaagtcaggctctacttgaggagaagcaaaaagaagaagacatagagaaaatgaaagagacagtttctcggtttgtacaagatgctaccataagaaccaagaaagaagttgcaaacaccaaaaaacaatgtaatatacaaatttctcgattaacagaagaactttcagcccttcaaatggagtgtgctgaaaaacaaggccaaattgaacgagtcattaaggaaaaaaaagcagtggaagaagaactagaaaagatttaccgtgaaggcagaggaaatgagagtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaagaactcattgccttcatcaatgtgtctgttttttaattcctcctttttcccttgaaaggacataataattttcaaactatgcaaatttctctttcataagaaagagtttttaagaaaattctagaatttaatatttcagtttccaagatttgagaattttacatctaattgttacttctaactcatttttaaagttcctaagtatccattttattatgaactcataaatgtaataaattgtgcactttctaaaa

SEQ ID NO: 182626 - DNA, 966 bp, Homo sapiens
  Payload ID: 15983
  Gene Symbol: SCLT1
  Gene Name: sodium channel and clathrin linker 1
  Uniprot ID: Q96NL6
  ENST ID: ENST00000439369
  CDS Start-End: 308-835
gagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctg

SEQ ID NO: 182627 - DNA, 1696 bp, Homo sapiens
  Payload ID: 15983
  Gene Symbol: SCLT1
  Gene Name: sodium channel and clathrin linker 1
  Uniprot ID: Q96NL6
  ENST ID: ENST00000511426
  CDS Start-End: 443-682
cgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcttaggaagcacaatcaagactaatacacaatcatgaattagttaccgttttaagtgagattttgcatgcttttacatgtaaattcagggttttgtgtgtgtgtgtgtgtgtgtgtgtgtgtgtgcgcgcgcgcacactctccatttgctcattcacacttactgagagttgactacttattttttgctattttgcttttactcatattttcgccaactttaaatgctttcttttcttttgaaatcctaacatctttttactccttcagagaacgttaatcagaccttcatttaattccctttctggtgtgcattttattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctttgttataaataaagaataagtctttcttatctgtaaa

SEQ ID NO: 182628 - DNA, 1364 bp, Homo sapiens
  Payload ID: 15983
  Gene Symbol: SCLT1
  Gene Name: sodium channel and clathrin linker 1
  ENST ID: ENST00000503215
  CDS Start-End: 379-1233
acgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggttgcacagtgaattaaaagatgctgttgaaaaaaaattggaggcctttcccctgggcacagaggtaggaactgacatatatgcagatgatgaaacagtcagaaaccttcaagaacaattgcagctagccaatcaagaaaaaactcaggctgtggaactctggcagactgtttctcaggagttggacagactacacaagctttaccaggaacatatgactgaggcccagattcatgtatttgaaagtcaaaaacaaaaggatcagctatttgattttcaacaactgaccaaacaacttcatgttactaatgagaacatggaagtgactaaccaacagtttctgaaaacagtaactgaacaaagtgtgataatcgaacaactccgaaaaaaacttaggagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctg

SEQ ID NO: 182629 - DNA, 2096 bp, Homo sapiens
  Payload ID: 15983
  Gene Symbol: SCLT1
  Gene Name: sodium channel and clathrin linker 1
  ENST ID: ENST00000506368
  CDS Start-End: 275-670
gaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaagagtcttgctctgtctcccaggctggagtgcagtggtgcgatctcggctcactgcaagctccgcctcccggattcgtgccattctcctgcctcagcctccccagtagctgggactacaggtgcccgtcaccacgcccatctaattttttttgtattttcagtagagacggggtttcaccatattagccaggatggtctcgatttcttgacctcatgatctgcccgcctcagcctcccattgttgaccatttttatatgtttatttacctatgtggttttcttttctcataaaatgcttgttcatatattttccccatttctacttatcttgttcttattaaattgccaaagtgcatatgtgatctgtattctgaaaatttgttgatgtgctggtcagtctcaacacagtaaacaataaccattctagaaatttgaaacaagaaaggatttaattcacttacatttaagtgctactaaatcattagttttacagttacacctcagagactataatcctggggttaggaatttatggtgctaccaccatccctggtgctaccaccatccctattactaccatggcagcattatttccataaaactggagacttgatattggaaaaagggtcataggatattgactacaagagacatttttgtctatccagttttacttaccagccaccatatcaacagaaaaaatggtctcagctcacttctaccttttatatctcccttaaatgcctctcactggtaaaattttaatcttatccacaacttcagctgcaagacatctgggcaatgtagttttggactttccgcccctgggacagaggccagaatgtggaagggaacagaaataaataatgagtgccagtggttcatacaacacattagataataggtgtttcaaatgtatattcccagactgtggtgtgtttgatgaacagaatttttttttcttttttttttttaacttaaagtaaatctctcactcttctcctgtggttattgttctttgtatctcctgtaagaagtcctttctcagcctaatgtcatagagatcttctcttatatttgctactaaaaaatgtttaaagcttttccataccaagtttcttaactttaacccataaaattcatataactggactgaaatctgatacatcattttttgttgacttttaactagactaaaaatccaaaattttttgagttctaaatttattcaaaacatgggctcttttaaagtttgacattcttttatttgtatttttctatgttatgtagtaattttattttattttgattatatttatttttattttagtgtagctatatttaaattaatacatgctgttccttaaaattacatagcacacccacggaattgtcttgcctttggctatttcatgattttctctcttccttgtattttccattagttttctttccttctaatttccaaaaacttcatatatttaagctgtcagtgtttactgaagtgcaaaataaagtacatcttttaattgg

SEQ ID NO: 182630 - DNA, 1604 bp, Homo sapiens
  Payload ID: 15983
  Gene Symbol: SCLT1
  Gene Name: sodium channel and clathrin linker 1
  ENST ID: ENST00000503401
  CDS Start-End: 457-627
caaagtcgcagggcgggccgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaagatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcttaggaagcacaatcaagactaatacacaatcatgaattagttaccgttttaagtgagattttgcatgcttttacatgtaaattcagggttttgtgtgtgtgtgtgtgtgtgtgtgtgtgtgtgcgcgcgcgcacactctccatttgctcattcacacttactgagagttgactacttattttttgctattttgcttttactcatattttcgccaactttaaatgctttcttttcttttgaaatcctaacatctttttactccttcagagaacgttaatcagaccttcatttaattccctttctggtgtgcattttattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctt

SEQ ID NO: 182631 - DNA, 869 bp, Homo sapiens
  Payload ID: 15984
  Gene Symbol: SCNM1
  Gene Name: sodium channel modifier 1
  Uniprot ID: Q9BWG6
  ENST ID: ENST00000368902
  CDS Start-End: 229-816
ctcttgctacggtggcctggaggagtggcgaaaccggaacagagaatttatcacttctgggactcacagtcgtgatgtctttcaagagggaaggagacgattggagtcaactcaatgtgctcaaagtaagcgtgagcggagaggatctggagccgcttcagtcgctccctgaagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaacttaa

SEQ ID NO: 182632 - DNA, 2016 bp, Homo sapiens
  Payload ID: 15984
  Gene Symbol: SCNM1
  Gene Name: sodium channel modifier 1
  Uniprot ID: Q9BWG6
  ENST ID: ENST00000368905
  CDS Start-End: 112-804
acaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaacttaactttccttaagtctggttccttgttggatctcaggatttcagatctgttcattctcattccaactactccttgcctgcaaggtacacagctctccacactccttttttttttttttttttttttgaggcagagtctcgctctatcgcccaggctggagtgcagtggcacgatctcggctcactgcaagctctgcctcccaggttcacgcctttctcctgcctcagcctcctgagtagctgggactacaggcgcccgccaccatgcccagctaattttttgtatttttagtagagacggggtttcactgtgttagccaggatggtctcgatctcctgacctcgtgatccgcccacctcggcctcccaaagtgctgggattacaggcatgagccaccgcacccagccacggctatccatacttctaacccctcccccacctcctaccaaagccatgccaagcgtcagctgcatcagcctggtgccctattaataagactgtcaaaaagaggtctttgcccttcatgttgtctgcctgcttctccactaccactcaaagtcctttcccccttcaaatcacataaggactgcaggtaggcactagggggacctggccacatctggaaacagggctgtggctaagttccctgtgaaagtagaagagtcaaaaggcattggcagggttatggggaacaccaagggagggaacacccccacctcctcctagtaacctgaacctccctgcctgctgatccccagagtataaataatcccctggtgaactggcagtaacccttgggggttagcgccaagattctcaccccaaagcccaaggaaggaggcaggcaaaatggatagaagggcttttatttacaggaaaggaggacagatgaggatttaagtgtccagtgctcccagcgctagttggtaaagggaaatgcagtgttatctcttcttttgctggcgacctgtaaaggagcaatattaaacataagtgtttgttccagctcctgctttctgcaaaggcactcttctcctttccagtcccttagccaaactcataaattggtagtgtcttaggccaccttacaggcccatcccacattaacaaaacaaaacaagaaaccacaccacaaataaaattacgatacctctaaacaag

SEQ ID NO: 182633 - DNA, 749 bp, Homo sapiens
  Payload ID: 15984
  Gene Symbol: SCNM1
  Gene Name: sodium channel modifier 1
  Uniprot ID: Q9BWG6
  ENST ID: ENST00000602841
  CDS Start-End: 114-701
tctccattctgtaagctttccgggaacatccaaggcaagactggcacccagcacagcagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaa

SEQ ID NO: 182634 - DNA, 3135 bp, Homo sapiens
  Payload ID: 15985
  Gene Symbol: SCNN1A
  Gene Name: sodium channel, non voltage gated 1 alpha subunit
  Uniprot ID: P37088
  ENST ID: ENST00000228916
  CDS Start-End: 100-2109
ccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 182635 - DNA, 2203 bp, Homo sapiens
  Payload ID: 15985
  Gene Symbol: SCNN1A
  Gene Name: sodium channel, non voltage gated 1 alpha subunit
  ENST ID: ENST00000338748
  CDS Start-End: 21-758
tgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctggaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaag

SEQ ID NO: 182636 - DNA, 3481 bp, Homo sapiens
  Payload ID: 15985
  Gene Symbol: SCNN1A
  Gene Name: sodium channel, non voltage gated 1 alpha subunit
  Uniprot ID: P37088
  ENST ID: ENST00000360168
  CDS Start-End: 265-2451
aaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaggaa

SEQ ID NO: 182637 - DNA, 2336 bp, Homo sapiens
  Payload ID: 15985
  Gene Symbol: SCNN1A
  Gene Name: sodium channel, non voltage gated 1 alpha subunit
  ENST ID: ENST00000396966
  CDS Start-End: 21-1556
tgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaag

SEQ ID NO: 182638 - DNA, 2361 bp, Homo sapiens
  Payload ID: 15985
  Gene Symbol: SCNN1A
  Gene Name: sodium channel, non voltage gated 1 alpha subunit
  Uniprot ID: P37088
  ENST ID: ENST00000543768
  CDS Start-End: 94-2172
aacctcagaaaactgatttatccttgggaagggtcagtttcttcattaggacaatgaagaaaaatccagctgtcccttccaaggggaggtatcatgagcagtatcaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcc

SEQ ID NO: 182639 - DNA, 3040 bp, Homo sapiens
  Payload ID: 15985
  Gene Symbol: SCNN1A
  Gene Name: sodium channel, non voltage gated 1 alpha subunit
  ENST ID: ENST00000540037
  CDS Start-End: 905-2014
gcggcactcaagccgaaaggccaccgacactcgcctgcggggatcagggcgggatgacctgggtaccgcggtcacgccaaggccgaggccctcacccttcccctctttgggaaagggcagacaagttccgggttcccttctaggtccgggcgagggggagagcgccccacagacgacaggcgcctcctgcctctctccttcaataaacagtccacagtgtcccggctgggctcgccgtggcctccgccttcccggcggacacacctgtttacccttcaccgccggacggccaggaggcgccacgacgaccccagccccgcccaggcttctccgggatggaccggcctcccggggcacagatgaggaccctgaccccggaggggccagacactcgctccagggcccctggcctgaccctcttcccctcgccccttcaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 182640 - DNA, 533 bp, Homo sapiens
  Payload ID: 15985
  Gene Symbol: SCNN1A
  Gene Name: sodium channel, non voltage gated 1 alpha subunit
  ENST ID: ENST00000536788
  CDS Start-End: 56-533
agaacctttgagatcaaacagccagggtgctgagcaccttattgcagggaggaccatgcccaatgggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctaca

SEQ ID NO: 182641 - DNA, 2085 bp, Homo sapiens
  Payload ID: 15986
  Gene Symbol: SCNN1B
  Gene Name: sodium channel, non voltage gated 1 beta subunit
  Uniprot ID: P51168
  ENST ID: ENST00000307331
  CDS Start-End: 28-2085
cttgagccctctcatcaccagttatccatgctgctgcatataaacccagcttatttatttaaactgctgcatggattcccgccgtggataatgcctaccgatgggaatttaggtgacaaaaattttcagatggggaaaccagggcacagagagggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 182642 - DNA, 2597 bp, Homo sapiens
  Payload ID: 15986
  Gene Symbol: SCNN1B
  Gene Name: sodium channel, non voltage gated 1 beta subunit
  Uniprot ID: P51168
  ENST ID: ENST00000343070
  CDS Start-End: 177-2099
gtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgagtcca

SEQ ID NO: 182643 - DNA, 1825 bp, Homo sapiens
  Payload ID: 15986
  Gene Symbol: SCNN1B
  Gene Name: sodium channel, non voltage gated 1 beta subunit
  ENST ID: ENST00000568085
  CDS Start-End: 9-1823
gtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaacc

SEQ ID NO: 182644 - DNA, 1852 bp, Homo sapiens
  Payload ID: 15986
  Gene Symbol: SCNN1B
  Gene Name: sodium channel, non voltage gated 1 beta subunit
  ENST ID: ENST00000568923
  CDS Start-End: 9-1850
gtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactagccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaacc

SEQ ID NO: 182645 - DNA, 1829 bp, Homo sapiens
  Payload ID: 15986
  Gene Symbol: SCNN1B
  Gene Name: sodium channel, non voltage gated 1 beta subunit
  ENST ID: ENST00000564275
  CDS Start-End: 9-899
gtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaacc

SEQ ID NO: 182646 - DNA, 749 bp, Homo sapiens
  Payload ID: 15986
  Gene Symbol: SCNN1B
  Gene Name: sodium channel, non voltage gated 1 beta subunit
  ENST ID: ENST00000566441
  CDS Start-End: 1-566
tagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggtgggaaggtggtgcacgcctcatgccccggggcccctgtccgggtttatggggccaaggcctcagtactccgggagagctggccccagcaagtctggctctgctgggcctttgtaggttgccacggggcaccccgggcctgtgggaccagtcactttcctgggctctctcaccagggcctagggttggccacttctcatccccacattggcaggtgtacccctggggaagcccaggggattatggggatcttactctggggtttcccaagatgaaaacaaaaaatagcagctaacacca

SEQ ID NO: 182647 - DNA, 2679 bp, Homo sapiens
  Payload ID: 15987
  Gene Symbol: SCNN1D
  Gene Name: sodium channel, non voltage gated 1 delta subunit
  Uniprot ID: P51172
  ENST ID: ENST00000325425
  CDS Start-End: 151-2265
gacatcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactcc

SEQ ID NO: 182648 - DNA, 3475 bp, Homo sapiens
  Payload ID: 15987
  Gene Symbol: SCNN1D
  Gene Name: sodium channel, non voltage gated 1 delta subunit
  Uniprot ID: P51172
  ENST ID: ENST00000338555
  CDS Start-End: 1145-3061
tataaatgcttctcatcagactcaaggcctgaggtgatgctgatgctgtgcctgaattccagcagggaggaggcatgaggtgcgtccgactcccttcccatcacagctgagctagtttttcaggttaactttggaatgcccatggctaagaccaggggtccatccagacagttcagggcttataattttatttttggtttatgagggaacctagaaggcagcccacacgcaccttactcctcccagcaggggacaccggccagaccccaagctccacactcccaccctcagcacccacccaggccagcagccgggggcaccttggtgccaccttagtgcctgttctgcggaggctccactggacagtgcagttgatgcccggggccgagggggctctgcctgggaggctgttcacctgcctgggtgcaggaccccagagggaccccaggccacccctggcctgcccatgcccacgggaatcccgaccttgggctgcctgtctattgcaccagaaccgtcccagggctgactcagagtgaccctgagtgggggacgctcaccccaggggaggaaacggggctctgggataggaggtcctggctggggtcccacagatgccaggcgcctgccatctccagggcagtgctgtcacagaagacaacaccgctccctcgttacctgtggcccggccacctcagcggcccaaggaggtgagctcacagccatgctcggtcaatggggcctggccgtctttcctgggagagagcagaggcatgggcccaaagggagccagggatgcctgcccgtcccttctctcattcaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactcc

SEQ ID NO: 182649 - DNA, 923 bp, Homo sapiens
  Payload ID: 15987
  Gene Symbol: SCNN1D
  Gene Name: sodium channel, non voltage gated 1 delta subunit
  ENST ID: ENST00000379099
  CDS Start-End: 1-923
tgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagcc

SEQ ID NO: 182650 - DNA, 3044 bp, Homo sapiens
  Payload ID: 15987
  Gene Symbol: SCNN1D
  Gene Name: sodium channel, non voltage gated 1 delta subunit
  ENST ID: ENST00000379116
  CDS Start-End: 227-2635
cctgggcgacagcgagactccatctcaataaataaaaaaaaaaaagagttgttatcagtagaagggaatgtctggttacagtatggcgttgtgcagatgaaggtcttatcgcagatgaagccaccaggtcacaagcctcagagagaatcaactataaatgcttctcatcagactcaaggcctgaggtgatgctgatgctgtgcctgaattccagcagggaggaggcatgagggcagtgctgtcacagaagacaacaccgctccctcgttacctgtggcccggccacctcagcggcccaaggaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttg

SEQ ID NO: 182651 - DNA, 2731 bp, Homo sapiens
  Payload ID: 15987
  Gene Symbol: SCNN1D
  Gene Name: sodium channel, non voltage gated 1 delta subunit
  Uniprot ID: P51172
  ENST ID: ENST00000400928
  CDS Start-End: 396-2312
agggcagtgctgtcacagaagacaacaccgctccctcgttacctgtggcccggccacctcagcggcccaaggaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctg

SEQ ID NO: 182652 - DNA, 645 bp, Homo sapiens
  Payload ID: 15987
  Gene Symbol: SCNN1D
  Gene Name: sodium channel, non voltage gated 1 delta subunit
  ENST ID: ENST00000470022
  CDS Start-End: 229-645
agccacaatctctggcaagcacctaggaccttgtccccgcctgccaagtagccgcccgggccatgtgtgccctgtctcctcggcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctg

SEQ ID NO: 182653 - DNA, 2268 bp, Homo sapiens
  Payload ID: 15987
  Gene Symbol: SCNN1D
  Gene Name: sodium channel, non voltage gated 1 delta subunit
  ENST ID: ENST00000379101
  CDS Start-End: 191-1177
aaaaaaaaagagttgttatcagtagaagggaatgtctggttacagtatggcgttgtgcagatgaaggtcttatcgcagatgaagccaccaggtcacaagcctcagagagaatcaactataaatgcttctcatcagactcaaggcctgaggtgatgctgatgctgtgcctgaattccagcagggaggaggcatgagggcagtgctgtcacagaagacaacaccgctccctcgttacctgtggcccggccacctcagcggcccaaggaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgcta

SEQ ID NO: 182654 - DNA, 2871 bp, Homo sapiens
  Payload ID: 15987
  Gene Symbol: SCNN1D
  Gene Name: sodium channel, non voltage gated 1 delta subunit
  ENST ID: ENST00000616713
  CDS Start-End: 41-2452
gaggtcctggctggggtcccacagatgccaggcgcctgccatctccagggcagtgctgtcacagaagacaacaccgctccctcgttacctgtggcccggccacctcagcggcccaaggaggctcacctggtcatggtgcagtgaccacaggacccccacatgccgggagctgggttcgccccaccccaccccctgcaccgggccagcgaggggatggcccagaagagggggaggaccatgtggattcaccagtgctggacatgtgctctgtggctaccccctctgcctactctctggcccgatacaggggtgtgggacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctg

SEQ ID NO: 182655 - DNA, 3507 bp, Homo sapiens
  Payload ID: 15988
  Gene Symbol: SCNN1G
  Gene Name: sodium channel, non voltage gated 1 gamma subunit
  Uniprot ID: P51170
  ENST ID: ENST00000300061
  CDS Start-End: 144-2093
ccacaagagcccgcggtggcgctgccaggggatgctagcccgagagcgagcagaggagcagcgcacccgcacgagccttggaccctttggaaccgaaagcacgcccgtcctcagagtcccgtcctcaaagtcccatcctcgccatggcacccggagagaagatcaaagccaaaatcaagaagaatctgcccgtgacgggccctcaggcgccgaccattaaagagctgatgcggtggtactgcctcaacaccaacacccatggctgtcgccgcatcgtggtgtcccgcggccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtacagcaccgttcgccaccttctagctgacttggaacaggagaccagagaggccctgaagtccctgtatggctttccagagtcccggaagcgccgagaggcggagtcctggaactccgtctcagagggaaagcagcctagattctcccaccggattccgctgctgatctttgatcaggatgagaagggcaaggccagggacttcttcacagggaggaagcggaaagtcggcggtagcatcattcacaaggcttcaaatgtcatgcacatcgagtccaagcaagtggtgggattccaactgtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggaatttcacgcttttccaccacccgatgcatgggaattgctatactttcaacaacagagaaaatgagaccattctcagcacctccatggggggcagcgaatatgggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctgacagagtccttcaagctgagtgagccctacagtcagtgcacggaggacgggagtgacgtgccaatcaggaacatctacaacgctgcctactcgctccagatctgccttcattcatgcttccagacaaagatggtggagaaatgtgggtgtgcccagtacagccagcctctacctcctgcagccaactactgcaactaccagcagcaccccaactggatgtattgttactaccaactgcatcgagcctttgtccaggaagagctgggctgccagtctgtgtgcaaggaagcctgcagctttaaagagtggacactaaccacaagcctggcacaatggccatctgtggtttcggagaagtggttgctgcctgttctcacttgggaccaaggccggcaagtaaacaaaaagctcaacaagacagacttggccaaactcttgatattctacaaagacctgaaccagagatccatcatggagagcccagccaacagtattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagagcccttggagtgttggtggagatcagagtgccgtggtggaggtctgggactatgtcagagtgtcctcactttggggcatgggtgggtccaggagatggatttagttattcaattttgtggatgaataaattgaggcacagaaagattaagttaccggcccaaggtgacacagtgaggaggtggcagagctaggatttgaacccagacaatctgacttcatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccaca

SEQ ID NO: 182656 - DNA, 8533 bp, Homo sapiens
  Payload ID: 15989
  Gene Symbol: SCN1A
  Gene Name: sodium channel, voltage gated, type I alpha subunit
  Uniprot ID: P35498
  ENST ID: ENST00000303395
  CDS Start-End: 419-6448
caagctatttgctgatttgtattaggtaccatagagtgaggcgaggatgaagccgagaggatactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggtttgggcaattatgaataaggctgctgtatacatccgtgtgcaggattttgtgtggacataagttttcaactcctttggttaaatcctaaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 182657 - DNA, 8097 bp, Homo sapiens
  Payload ID: 15989
  Gene Symbol: SCN1A
  Gene Name: sodium channel, voltage gated, type I alpha subunit
  Uniprot ID: P35498
  ENST ID: ENST00000375405
  CDS Start-End: 19-6015
aatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagagggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatt

SEQ ID NO: 182658 - DNA, 5946 bp, Homo sapiens
  Payload ID: 15989
  Gene Symbol: SCN1A
  Gene Name: sodium channel, voltage gated, type I alpha subunit
  Uniprot ID: P35498
  ENST ID: ENST00000409050
  CDS Start-End: 1-5946
atggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttgggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataa

SEQ ID NO: 182659 - DNA, 8191 bp, Homo sapiens
  Payload ID: 15989
  Gene Symbol: SCN1A
  Gene Name: sodium channel, voltage gated, type I alpha subunit
  Uniprot ID: P35498
  ENST ID: ENST00000423058
  CDS Start-End: 77-6106
aaaatatctgtattccttttattttaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaagggaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacagcagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaagaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatcttcggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgcactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 182660 - DNA, 1451 bp, Homo sapiens
  Payload ID: 15990
  Gene Symbol: SCN1B
  Gene Name: sodium channel, voltage gated, type I beta subunit
  Uniprot ID: Q07699
  ENST ID: ENST00000262631
  CDS Start-End: 138-794
ctcgccggtcccagagccgcagctgctgcgcccgcgcgctcccggggacattctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcctcggaatacctggccatcacctctgaaagcaaagagaactgcacgggcgtccaggtggccgaatagccctggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggcggtgaggtgggggcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtcccccctccctgtaatgcactcctgccccggcccaacctcgccctctctcaccagccttgaactgtggccacctagaaaggggcccattcagcctcgtctctttacagaagtagttttgttcatgaaataaagactcttggacttg

SEQ ID NO: 182661 - DNA, 979 bp, Homo sapiens
  Payload ID: 15990
  Gene Symbol: SCN1B
  Gene Name: sodium channel, voltage gated, type I beta subunit
  Uniprot ID: Q07699
  ENST ID: ENST00000415950
  CDS Start-End: 1-807
atggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaaggtgagtcgggtgctgcctgcccctttaccgtcacccaccggagagccagatggagggacagatggcaggcagtggacaggacaggctggctctgtgcctggccagccaaccgcccacagcagcgggctgagggggaggggagcagcccctcctgcccactccagctctggcctctgtttctctccagcccacggagaggtcaaagcatgcctgtcccccacagacgctccgggtacagaacccagctctgtcacctgtgctgtatgacctctggcaggtgccttctgtctctgagccaaagggttgtcctgggcttgcccgggataataatccgatgtgtttctcggggtgtggtttgagccattcttccatcatggggttcatgaggattgagcagctgcaggcacacgcctggcttccagcagagccttgcaggtggtggcgagggtggcggttcttactgttcgagtagctcagccctgctgccctctgtggtgatgaggcaagagagcgtgccacctagagcagagt

SEQ ID NO: 182662 - DNA, 814 bp, Homo sapiens
  Payload ID: 15990
  Gene Symbol: SCN1B
  Gene Name: sodium channel, voltage gated, type I beta subunit
  ENST ID: ENST00000595652
  CDS Start-End: 89-532
attctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagaagatccacattgaggtagtggacaaagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcctcggaatacctggccatcacctctgaaagcaaagagaactgcacgggcgtccaggtggccgaatagccctggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggc

SEQ ID NO: 182663 - DNA, 8660 bp, Homo sapiens
  Payload ID: 15991
  Gene Symbol: SCN2A
  Gene Name: sodium channel, voltage gated, type II alpha subunit
  Uniprot ID: Q99250
  ENST ID: ENST00000283256
  CDS Start-End: 157-6174
aaaaaaaagatttttttttttttaaagcatgatggaattttagctgcagtcttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 182664 - DNA, 8553 bp, Homo sapiens
  Payload ID: 15991
  Gene Symbol: SCN2A
  Gene Name: sodium channel, voltage gated, type II alpha subunit
  Uniprot ID: Q99250
  ENST ID: ENST00000375427
  CDS Start-End: 52-6069
cactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacatttt

SEQ ID NO: 182665 - DNA, 8792 bp, Homo sapiens
  Payload ID: 15991
  Gene Symbol: SCN2A
  Gene Name: sodium channel, voltage gated, type II alpha subunit
  Uniprot ID: Q99250
  ENST ID: ENST00000375437
  CDS Start-End: 291-6308
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacatttt

SEQ ID NO: 182666 - DNA, 1807 bp, Homo sapiens
  Payload ID: 15991
  Gene Symbol: SCN2A
  Gene Name: sodium channel, voltage gated, type II alpha subunit
  ENST ID: ENST00000424833
  CDS Start-End: 291-1807
atgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaa

SEQ ID NO: 182667 - DNA, 8430 bp, Homo sapiens
  Payload ID: 15991
  Gene Symbol: SCN2A
  Gene Name: sodium channel, voltage gated, type II alpha subunit
  Uniprot ID: Q99250
  ENST ID: ENST00000631182
  CDS Start-End: 205-6222
cctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcgtatgtaacagaatttgtaaacctaggcaatgtttcagctcttcgaactttcagagtcttgagagctttgaaaactatttctgtaattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggttt

SEQ ID NO: 182668 - DNA, 661 bp, Homo sapiens
  Payload ID: 15991
  Gene Symbol: SCN2A
  Gene Name: sodium channel, voltage gated, type II alpha subunit
  ENST ID: ENST00000486878
  CDS Start-End: 1-537
tggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatataatggaaattatctcaatttagatgtgaatcaagtgacttagactaatttaagatgatttaatacatataaaagagatatcaaatgata

SEQ ID NO: 182669 - DNA, 5826 bp, Homo sapiens
  Payload ID: 15992
  Gene Symbol: SCN2B
  Gene Name: sodium channel, voltage gated, type II beta subunit
  Uniprot ID: O60939
  ENST ID: ENST00000278947
  CDS Start-End: 243-890
ttttctctcccccccatctctctctctctcctttacacactccctctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcccgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcagccacactactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaaaaaaaaaaaaaaaaggcaattgtgcggagccaaccatcactgccattacactcacattcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcaacagagccatcattttcccagtgggaggggcctctgtgtcctggtctatgatggggcgagttggaggggtgggcttctctagccctgccccctcccaggagcccagcccctctggccaggactgaggaggagtggagggaagcagggagggagggagcaagtgtgaagggcacagctgctggcaaatgccccattccctgccccagcacttcccagcctttccaggagctctgccccacccctactcaaggagtcaggtgcccagggtagggaataagtctaggaaagggggtggagacaggaccgtgacagtctcagggaccaatccctgcctctgcccatcagattgccaatttggggagacagcaatatcatctgggagattcagcttaatttgcttcaattcagcaaccatttattgagcatctattatgtgccaggcactgtgccgggcactggggatatacacaaagccataagcactggggactgccaggttggcactgtagggaccaagattaactttttggtgcatctaattccacctctgcaagacactgcttccaaggctacagttggggaagatgaagagattctagaatctgtgccctgggaagggagaaacagcagggaagaggggcaatacaacagggtcaagggtgcagaggccaggcagagtgggtgcagagtgggggatgggcaaccagcctggtaacacctgggtgaggtgagcgagtcaagcccatctggaaatgctaaactcatcagctcagtacctaactgccaatcaacacactgccaatgcgggtgggctaagccgccaggatgcctgcagcagatggacgctgcccatccttgagccagccagctgggggcagagaggtgggtggcgggcacctcatgccagctgagaccaagagtggttgtatacatttctgcagcttgcagatttcatttttttggtcaccctttaagtgtccttctctcccaggatgagtgaggagctgtgctgatgttgggaacttatctttttccaggatccataacatttaggggaattatttgcgggctttcctagtgtattctaagaagttctaactctccatcaagaagcccaagattcctggagtctttttttcctctgccctgatcaactggggcccaggaaaagcaatgtctcttcacgggcctcagggccccagcagatggggctgggtcaggaaccatctctgtcccaggtgctcagccctcatatgcattttcttctggagcctcttagaatctcctccagaggactcatagagctgcctcccccaggatggtgaagttgggagcaaaatggggcttctgtaagtagaggtggaaaaccagagagatgtttccacagcagccatttccctaccctgtttcctaacttatgctgacaagttcttcctcttcctaccgtggggttcgagccccacttctggttgcatgttcccaccaccacgctctgctggttttagtcggctgactttctcaactgccccagcctctcctgctctctcagaacctccctctgcccccaccccccatctgtctcttcctcctaattaagggccactgcaaagagagacgggctggctaacccatgggatttagcttataagaacaaagcacaattattcaggactgaactgctttgaggtgccttggaactggctttggaaatagctatctgccccctagctatggactcttcacagttatttccagtttataaaaaggaaaagctgatcggatccatgtttctctctgcgagtctccttggggaggttgggctggtaaatatttgcaaggtcaggttaagcagacagacaattgaaaatactgggcaggtccaaaaggatagttccaggccataggaatggcttggtgcagttaacgggtgatgaagcaagaaatcttccttcctacttatgtcttaaagatggacagcctgtgtctcttgctgtgcctcttgctggcgtcttcctttattgaagcttgctgatgcactgtacatagtctctctctctaggtatagatatattatatatacaaatatcaaacatctcaccacacccaccccaaaagttacactgtgtgtgtgtggggaggtgtaataacttctcagtgttttgagttgattcaccaaaggcaaattttggaatgttcttgcgctttgtgcacttggaggggaaaacccaactacatatgcactttcttggttgtgtgtgctatagagaggttggaaggggtggttggaaggggagagaaactgagatggccctctgtgactcgactgctgggatgtatctgcttttgggagcagactgagtttcttttgcaatttgtcttattgtttgggtctactggcaacaataaactatctcccctgaaaatccctcgagtgtggctttattcaggggttcagggcagggtaggctgatgcttcaccaggatcttaactggaaccctaggtgctcctttcctggtaatcccattggcgctgccagatctccagcatctgagggcctcaatgcccctgcctcacaaggggaaggttgtctaccccacacttgtgcccccacagatgtttcatccctttgccttccccaaccccctggggactccgctcaccctggaacagagtggctgaacacctacttcttggagggctctcgattattttggggatgaagacaaccccggaagctcccaaggctgactgtcatgcggatgttgcctgtcctttgcatgggcagacaggccatccttcctgctctgttccccaaaggtgttggattagacatttcttttgcctcctctggactcagaaagaatagatgacagctggtcagagtctgccctcatgcagttcatggagaagggtggctgtgggaaggttcaggtggctcatgtcccatctacatactgctggatcctatatatatgtgccaaagcagccctaagaagtttaggaccaagggcaacctcctggctaggggctccactgtcccagacaggcctttttttctcccttgctcttcattcttccgtctctttgcatttctccctctctcccttgcaccgctctctctctctctctctctctctctctgtctgtctgtctctctctctcttgcctaggaggcttaccaggcttaccttcctcttcctactctggggttcgagccccacttctggctgcatgctccggccaccacgctctggtggtttcagtctgctgactttct

SEQ ID NO: 182670 - DNA, 9091 bp, Homo sapiens
  Payload ID: 15993
  Gene Symbol: SCN3A
  Gene Name: sodium channel, voltage gated, type III alpha subunit
  Uniprot ID: Q9NY46
  ENST ID: ENST00000283254
  CDS Start-End: 469-6471
gaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctagatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtgg

SEQ ID NO: 182671 - DNA, 9123 bp, Homo sapiens
  Payload ID: 15993
  Gene Symbol: SCN3A
  Gene Name: sodium channel, voltage gated, type III alpha subunit
  Uniprot ID: Q9NY46
  ENST ID: ENST00000360093
  CDS Start-End: 493-6495
accatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagagggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctagatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggctaattgg

SEQ ID NO: 182672 - DNA, 6599 bp, Homo sapiens
  Payload ID: 15993
  Gene Symbol: SCN3A
  Gene Name: sodium channel, voltage gated, type III alpha subunit
  Uniprot ID: Q9NY46
  ENST ID: ENST00000409101
  CDS Start-End: 312-6167
taccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcgtatgtaacagaatttgtaagcctaggcaatgtttcagcccttcgaactttcagagtcttgagagctctgaaaactatttctgtaattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttt

SEQ ID NO: 182673 - DNA, 1216 bp, Homo sapiens
  Payload ID: 15993
  Gene Symbol: SCN3A
  Gene Name: sodium channel, voltage gated, type III alpha subunit
  ENST ID: ENST00000453007
  CDS Start-End: 616-1216
agaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggggaaaagctgagagtctggaactagcctatcttccgaggacttagagacaacagtatgggaatttcaacgagacgtttttactttcttttgaccaagattcaaattctttattccagcccttgataagtaaataagaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatgg

SEQ ID NO: 182674 - DNA, 4146 bp, Homo sapiens
  Payload ID: 15993
  Gene Symbol: SCN3A
  Gene Name: sodium channel, voltage gated, type III alpha subunit
  ENST ID: ENST00000440431
  CDS Start-End: 55-4146
taaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactactgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacggcaccaccacagaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagaccttaaaccggaagcttgttttactgaaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtg

SEQ ID NO: 182675 - DNA, 5665 bp, Homo sapiens
  Payload ID: 15994
  Gene Symbol: SCN3B
  Gene Name: sodium channel, voltage gated, type III beta subunit
  Uniprot ID: Q9NY72
  ENST ID: ENST00000299333
  CDS Start-End: 408-1055
tgtcagggctgacagcacacacggcctgggggcctagagaagggttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcaataaagtatccctgaaaacc

SEQ ID NO: 182676 - DNA, 6061 bp, Homo sapiens
  Payload ID: 15994
  Gene Symbol: SCN3B
  Gene Name: sodium channel, voltage gated, type III beta subunit
  Uniprot ID: Q9NY72
  ENST ID: ENST00000392770
  CDS Start-End: 804-1451
cagggctgacagcacacacggcctgggggcctagagaagggttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagaggtgaatcaacctggacccttccacagcctggctgctaggccagcagtgcgactcccttccgagctgagcttaccctgggcgcaaacgagcgaggcaggggcgcgagtggaagctggagttccggggtgggcggggaggcgactgtccgtggtgctgagcgccggcgagagcgggcgcggagcggctgatcggctccctcgaactggggaggtccagtggggtcgcttagggcccaaagcccccacccggctccaaaagctcccagggcctccccaggcaccggtgctcggcccttccttcggtcagaaagtcgccccctgggggcagttcgtcccaaagggtttcctcgaaagaatctgagagggcgcagtccttgaccgagggaatctctctgtgtagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcaataaagtatccctgaaaacc

SEQ ID NO: 182677 - DNA, 3984 bp, Homo sapiens
  Payload ID: 15994
  Gene Symbol: SCN3B
  Gene Name: sodium channel, voltage gated, type III beta subunit
  Uniprot ID: Q9NY72
  ENST ID: ENST00000530277
  CDS Start-End: 408-1055
tgtcagggctgacagcacacacggcctgggggcctagagaagggttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtgacctacaggaacatgggaggggaaggcagatgtggatggcaggttgtacaagtgactttgttgcccacaactgaagtgactttaaatttggtcccttaggtcactgtctaccctgcctggggtccccgccctcagggtaattctttaagtcagaaagctctgtatgatgtcagcgcttcggaaggtgaactgctttgacctgagtgtcgaggcaatctgaacttgcccatggtaacagaggcacaggattctccaactcccttctttggtcaaagaatttttgggctgggctgggctggactgggtgggaaattctcagtgagttattttatctttggtaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactca

SEQ ID NO: 182678 - DNA, 443 bp, Homo sapiens
  Payload ID: 15994
  Gene Symbol: SCN3B
  Gene Name: sodium channel, voltage gated, type III beta subunit
  ENST ID: ENST00000528267
  CDS Start-End: 163-443
attaaaaaggagtaattaaaggaaaagggagaactgcaaagaacctggggaagggaagaggagtcctcttgggcccccctccccttgcgctgacatttggatcacctcactgagtgatgaggtgaagacaggaacagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtg

SEQ ID NO: 182679 - DNA, 566 bp, Homo sapiens
  Payload ID: 15994
  Gene Symbol: SCN3B
  Gene Name: sodium channel, voltage gated, type III beta subunit
  ENST ID: ENST00000527836
  CDS Start-End: 143-566
gagaactggaaggcatggggtctgggaggcgaagccaggaaccgcgtacggcgcgccttgcagatgacatcattgcctgaaagagctctggcccttctcttcccggagctacacccgccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatcc

SEQ ID NO: 182680 - DNA, 7805 bp, Homo sapiens
  Payload ID: 15995
  Gene Symbol: SCN4A
  Gene Name: sodium channel, voltage gated, type IV alpha subunit
  Uniprot ID: P35499
  ENST ID: ENST00000435607
  CDS Start-End: 78-5588
ccagcaccccggggctgcgcactgcagctccccaggccacccaccacccttctggtctctgagcccaggatgcgaggatggccagaccatctctgtgcaccctggtgcctctgggccctgagtgcttgcgccccttcacccgggagtcactggcagccatagaacagcgggcggtggaggaggaggcccggctgcagcggaataagcagatggagattgaggagcccgaacggaagccacgaagtgacttggaggctggcaagaacctacccatgatctacggagaccccccgccggaggtcatcggcatccccctggaggacctggatccctactacagcaataagaagaccttcatcgtactcaacaagggcaaggccatcttccgcttctccgccacacctgctctctacctgctgagccccttcagcgtagtcaggcgcggggccatcaaggtgctcatccatgcgctgttcagcatgttcatcatgatcaccatcttgaccaactgcgtattcatgaccatgagtgacccgcctccctggtccaagaatgtggagtacaccttcacagggatctacacctttgagtccctcatcaagatactggcccgaggcttctgtgtcgacgacttcacattcctccgggacccctggaactggctggacttcagtgtcatcatgatggcgtacctgacagagtttgtggacttgggcaacatctcagccctgaggaccttccgggtgctgcgggccctcaaaaccatcacggtcatcccagggctgaagacgatcgtgggggccctgatccagtcggtgaaaaagctgtcggatgtgatgatcctcactgtcttctgcctgagcgtctttgcgctggtaggactgcagctcttcatgggaaacctgaggcagaagtgtgtgcgctggcccccgccgttcaacgacaccaacaccacgtggtacagcaatgacacgtggtacggcaatgacacatggtatggcaatgagatgtggtacggcaatgactcatggtatgccaacgacacgtggaacagccatgcaagctgggccaccaacgatacctttgattgggacgcctacatcagtgatgaagggaacttctacttcctggagggctccaacgatgccctgctctgtgggaacagcagtgatgctgggcactgccctgagggttatgagtgcatcaagaccgggcggaaccccaactatggctacaccagctatgacaccttcagctgggccttcttggctctcttccgcctcatgacacaggactattgggagaacctcttccagctgacccttcgagcagctggcaagacctacatgatcttcttcgtggtcatcatcttcctgggctctttctacctcatcaatctgatcctggccgtggtggccatggcatatgccgagcagaatgaggccaccctggccgaggataaggagaaagaggaggagtttcagcagatgcttgagaagttcaaaaagcaccaggaggagctggagaaggccaaggccgcccaagctctggaaggtggggaggcagatggggacccagcccatggcaaagactgcaatggcagcctggacacatcgcaaggggagaagggagccccgaggcagagcagcagcggagacagcggcatctccgacgccatggaagaactggaagaggcccaccaaaagtgcccaccatggtggtacaagtgcgcccacaaagtgctcatatggaactgctgcgccccgtggctgaagttcaagaacatcatccacctgatcgtcatggacccgttcgtggacctgggcatcaccatctgcatcgtgctcaacaccctcttcatggccatggaacattaccccatgacggagcactttgacaacgtgctcactgtgggcaacctggtcttcacaggcatcttcacagcagagatggttctgaagctgattgccatggacccctacgagtatttccagcagggttggaatatcttcgacagcatcatcgtcaccctcagcctggtagagctaggcctggccaacgtacagggactgtctgtgctacgctccttccgtctgctgcgggtcttcaagctggccaagtcgtggccaacgctgaacatgctcatcaagatcattggcaattcagtgggggcgctgggtaacctgacgctggtgctggctatcatcgtgttcatcttcgccgtggtgggcatgcagctgtttggcaagagctacaaggagtgcgtgtgcaagattgccttggactgcaacctgccgcgctggcacatgcatgatttcttccactccttcctcatcgtcttccgcatcctgtgcggggagtggatcgagaccatgtgggactgcatggaggtggccggccaagccatgtgcctcaccgtcttcctcatggtcatggtcatcggcaatcttgtggtcctgaacctgttcctggctctgctgctgagctccttcagcgccgacagtctggcagcctcggatgaggatggcgagatgaacaacctgcagattgccatcgggcgcatcaagttgggcatcggctttgccaaggccttcctcctggggctgctgcatggcaagatcctgagccccaaggacatcatgctcagcctcggggaggctgacggggccggggaggctggagaggcgggggagactgcccccgaggatgagaagaaggagccgcccgaggaggacctgaagaaggacaatcacatcctgaaccacatgggcctggctgacggccccccatccagcctcgagctggaccaccttaacttcatcaacaacccctacctgaccatacaggtgcccatcgcctccgaggagtccgacctggagatgcccaccgaggaggaaaccgacactttctcagagcctgaggatagcaagaagccgccgcagcctctctatgatgggaactcgtccgtctgcagcacagctgactacaagccccccgaggaggaccctgaggagcaggcagaggagaaccccgagggggagcagcctgaggagtgcttcactgaggcctgcgtgcagcgctggccctgcctctacgtggacatctcccagggccgtgggaagaagtggtggactctgcgcagggcctgcttcaagattgtcgagcacaactggttcgagaccttcattgtcttcatgatcctgctcagcagtggggctctggccttcgaggacatctacattgagcagcggcgagtcattcgcaccatcctagaatatgccgacaaggtcttcacctacatcttcatcatggagatgctgctcaaatgggtggcctacggctttaaggtgtacttcaccaacgcctggtgctggctcgacttcctcatcgtggatgtctccatcatcagcttggtggccaactggctgggctactcggagctgggacccatcaaatccctgcggacactgcgggccctgcgtcccctgagggcactgtcccgattcgagggcatgagggtggtggtgaacgccctcctaggcgccatcccctccatcatgaatgtgctgcttgtctgcctcatcttctggctgatcttcagcatcatgggtgtcaacctgtttgccggcaagttctactactgcatcaacaccaccacctctgagaggttcgacatctccgaggtcaacaacaagtctgagtgcgagagcctcatgcacacaggccaggtccgctggctcaatgtcaaggtcaactacgacaacgtgggtctgggctacctctccctcctgcaggtggccaccttcaagggttggatggacatcatgtatgcagccgtggactcccgggagaaggaggagcagccgcagtacgaggtgaacctctacatgtacctctactttgtcatcttcatcatctttggctccttcttcaccctcaacctcttcattggcgtcatcattgacaacttcaaccagcagaagaagaagttaggggggaaagacatctttatgacggaggaacagaagaaatactataacgccatgaagaagcttggctccaagaagcctcagaagccaattccccggccccagaacaagatccagggcatggtgtatgacctcgtgacgaagcaggccttcgacatcaccatcatgatcctcatctgcctcaacatggtcaccatgatggtggagacagacaaccagagccagctcaaggtggacatcctgtacaacatcaacatgatcttcatcatcatcttcacaggggagtgcgtgctcaagatgctcgccctgcgccagtactacttcaccgttggctggaacatctttgacttcgtggtcgtcatcctgtccattgtgggccttgccctctctgacctgatccagaagtacttcgtgtcacccacgctgttccgtgtgatccgcctggcgcggattgggcgtgtcctgcggctgatccgcggggccaagggcatccggacgctgctgttcgccctcatgatgtcgctgcctgccctcttcaacatcggcctcctcctcttcctggtcatgttcatctactccatcttcggcatgtccaactttgcctacgtcaagaaggagtcgggcatcgatgatatgttcaacttcgagaccttcggcaacagcatcatctgcctgttcgagatcaccacgtcggccggctgggacgggctcctcaaccccatcctcaacagcgggcccccagactgtgaccccaacctggagaacccgggcaccagtgtcaagggtgactgcggcaacccctccatcggcatctgcttcttctgcagctatatcatcatctccttcctcatcgtggtcaacatgtacatcgccatcatcctggagaacttcaatgtggccacagaggagagcagcgagccccttggtgaagatgactttgagatgttctacgagacatgggagaagttcgaccccgacgccacccagttcatcgcctacagccgcctctcagacttcgtggacaccctgcaggaaccgctgaggattgccaagcccaacaagatcaagctcatcacactggacttgcccatggtgccaggggacaagatccactgcctggacatcctctttgccctgaccaaagaggtcctgggtgactctggggaaatggacgccctcaagcagaccatggaggagaagttcatggcagccaacccctccaaggtgtcctacgagcccatcaccaccaccctcaagaggaagcacgaggaggtgtgcgccatcaagatccagagggcctaccgccggcacctgctacagcgctccatgaagcaggcatcctacatgtaccgccacagccacgacggcagcggggatgacgcccctgagaaggaggggctgcttgccaacaccatgagcaagatgtatggccacgagaatgggaacagcagctcgccaagcccggaggagaagggcgaggcaggggacgccggacccactatggggctgatgcccatcagcccctcagacactgcctggcctcccgcccctcccccagggcagactgtgcgcccaggtgtcaaggagtctcttgtctagcaggcagcatcggggtggcccactgagtctcggcatagtccccagagctcccccgtggtgcctgcacacagagtgagggaggagggctttgaatctgggactgtgcctggctccctgatgggggacaggatttggccacactggggctgacacccaggcccgagcgcctgcgttcccagaccatgggaaatgggaattgcgctcaggggctccatgctgggtctgaggcccctgcctccaagatttaacctgcaagttgctctgacctcctctgggccctgtcgcccctccttttggcctgggggaggtcagaacattcgaatctctgcccctcacttgaggaggagctggcctgcggtggagggatcagttgccccccatcaccagagtcttaagggtcactggcctctccccaggaagtggctcagacccctcagccccagcccagacaaagatgtcttaacctcagggagtgcagacacctaaccccagggcactgccagcccaccccctttgactctggggtgcagcttcacccaccaggccagctcaggaattccctggaaaagggaaatgtgactggttcagaaatagctcctcaaagcctcaaaacctgattggccactggatcctgctgctttgggctgggatggtgactcctgaaacctcttcctaggccacgtccaggtccgtagctcccctggctggctcctaggggaagagcagaaggaaggatgccacttgggaatgaattgtccttttctaggaagcacgggggagtgagacaggctgggtcctgccagctggatcgctgcacatggcctgagcatccagacctgagcgggagtcagggacctgctgctcagtaagaagattctcgccccttccctctctccctgcctcactcctccgtgagcaccaccagggctccaggagcctcatccagcctcagagatctcccttctcatctccccacgcccgtctctttctcacctttcccacctctctccccaaagtgatcctaagaatgtacagttgagctcaggttagatatttcgaccctggggcgtgcagcagggaaggcccaactggttcaggctcaaccttccaacttcctgtggcctgaagaagcacttctgctgcatcgctgttctgggcatggcagggccaggcctctgctggctcaggaggaggggtgagagacctgctcaggcgtcgctggatttattcacttgtgtgtgtacctgtggctgtgtgtctgcttgtatgcttttataggcctgtgtgtatagctgtgtgtgtgttcaagtgcgtgactgtatgtgtgtgtgtgaaccactgtgtactggagcctgcattatgcacgtgtctgggtatctttgtatatatgtgtatatatgtgtgccctggactgtttcaaggtccatggagtacggctggtgtgtcatactgtgcaggcctgtccctgggagtgttcccgtgcctgggagagtggacctgtgctgtgagtgtgtggatgcgtgtgaacgcatgtggtaaggtgtgtactcagggcattctgttggcctaagtgcctcttctttttcttcttgtttctcatgaaaagtttgattaaaattcaggaagcagcaaaaccttcaaaacaagacatgtatgtgtgcttgagtgtgtgaacacgtgtgtgtgtgtgcacatctacatgccatgcctatgggccagagttgtctttattgtccaccatgctctctcacctgctcccagtcctgcctgaacagccctctctctcactcccctctcctccccttcctgtttctcgttgtcacacccatggcctcagccctgctccctgcctcctgcctatgtctcctctatggaaggaggcctccactccttccatctcttccttcagaagtttcgtctaatgggggcagtctccccttcctggcacattgcccctctgccttgccctcctgggccctgggctggcacagcccctggagcctcagaaatctgtttgattggatattctcctcggactgtgtgcaggttgcagaggaagagtagatgagccgggtccggcctctccctgcctgtggcccctcccctgcagacggatgcccattcctgcctggtccagtggggaacaggtcccacgccaggccagcaggcgggctcctttgtacagttcttacaataaaccctccttggtgcctctgg

SEQ ID NO: 182681 - DNA, 7805 bp, Homo sapiens
  Payload ID: 15995
  Gene Symbol: SCN4A
  Gene Name: sodium channel, voltage gated, type IV alpha subunit
  ENST ID: ENST00000578147
  CDS Start-End: 78-5588
ccagcaccccggggctgcgcactgcagctccccaggccacccaccacccttctggtctctgagcccaggatgcgaggatggccagaccatctctgtgcaccctggtgcctctgggccctgagtgcttgcgccccttcacccgggagtcactggcagccatagaacagcgggcggtggaggaggaggcccggctgcagcggaataagcagatggagattgaggagcccgaacggaagccacgaagtgacttggaggctggcaagaacctacccatgatctacggagaccccccgccggaggtcatcggcatccccctggaggacctggatccctactacagcaataagaagaccttcatcgtactcaacaagggcaaggccatcttccgcttctccgccacacctgctctctacctgctgagccccttcagcgtagtcaggcgcggggccatcaaggtgctcatccatgcgctgttcagcatgttcatcatgatcaccatcttgaccaactgcgtattcatgaccatgagtgacccgcctccctggtccaagaatgtggagtacaccttcacagggatctacacctttgagtccctcatcaagatactggcccgaggcttctgtgtcgacgacttcacattcctccgggacccctggaactggctggacttcagtgtcatcatgatggcgtacctgacagagtttgtggacttgggcaacatctcagccctgaggaccttccgggtgctgcgggccctcaaaaccatcacggtcatcccagggctgaagacgatcgtgggggccctgatccagtcggtgaaaaagctgtcggatgtgatgatcctcactgtcttctgcctgagcgtctttgcgctggtaggactgcagctcttcatgggaaacctgaggcagaagtgtgtgcgctggcccccgccgttcaacgacaccaacaccacgtggtacagcaatgacacgtggtacggcaatgacacatggtatggcaatgagatgtggtacggcaatgactcatggtatgccaacgacacgtggaacagccatgcaagctgggccaccaacgatacctttgattgggacgcctacatcagtgatgaagggaacttctacttcctggagggctccaacgatgccctgctctgtgggaacagcagtgatgctgggcactgccctgagggttatgagtgcatcaagaccgggcggaaccccaactatggctacaccagctatgacaccttcagctgggccttcttggctctcttccgcctcatgacacaggactattgggagaacctcttccagctgacccttcgagcagctggcaagacctacatgatcttcttcgtggtcatcatcttcctgggctctttctacctcatcaatctgatcctggccgtggtggccatggcatatgccgagcagaatgaggccaccctggccgaggataaggagaaagaggaggagtttcagcagatgcttgagaagttcaaaaagcaccaggaggagctggagaaggccaaggccgcccaagctctggaaggtggggaggcagatggggacccagcccatggcaaagactgcaatggcagcctggacacatcgcaaggggagaagggagccccgaggcagagcagcagcggagacagcggcatctccgacgccatggaagaactggaagaggcccaccaaaagtgcccaccatggtggtacaagtgcgcccacaaagtgctcatatggaactgctgcgccccgtggctgaagttcaagaacatcatccacctgatcgtcatggacccgttcgtggacctgggcatcaccatctgcatcgtgctcaacaccctcttcatggccatggaacattaccccatgacggagcactttgacaacgtgctcactgtgggcaacctggtcttcacaggcatcttcacagcagagatggttctgaagctgattgccatggacccctacgagtatttccagcagggttggaatatcttcgacagcatcatcgtcaccctcagcctggtagagctaggcctggccaacgtacagggactgtctgtgctacgctccttccgtctgctgcgggtcttcaagctggccaagtcgtggccaacgctgaacatgctcatcaagatcattggcaattcagtgggggcgctgggtaacctgacgctggtgctggctatcatcgtgttcatcttcgccgtggtgggcatgcagctgtttggcaagagctacaaggagtgcgtgtgcaagattgccttggactgcaacctgccgcgctggcacatgcatgatttcttccactccttcctcatcgtcttccgcatcctgtgcggggagtggatcgagaccatgtgggactgcatggaggtggccggccaagccatgtgcctcaccgtcttcctcatggtcatggtcatcggcaatcttgtggtcctgaacctgttcctggctctgctgctgagctccttcagcgccgacagtctggcagcctcggatgaggatggcgagatgaacaacctgcagattgccatcgggcgcatcaagttgggcatcggctttgccaaggccttcctcctggggctgctgcatggcaagatcctgagccccaaggacatcatgctcagcctcggggaggctgacggggccggggaggctggagaggcgggggagactgcccccgaggatgagaagaaggagccgcccgaggaggacctgaagaaggacaatcacatcctgaaccacatgggcctggctgacggccccccatccagcctcgagctggaccaccttaacttcatcaacaacccctacctgaccatacaggtgcccatcgcctccgaggagtccgacctggagatgcccaccgaggaggaaaccgacactttctcagagcctgaggatagcaagaagccgccgcagcctctctatgatgggaactcgtccgtctgcagcacagctgactacaagccccccgaggaggaccctgaggagcaggcagaggagaaccccgagggggagcagcctgaggagtgcttcactgaggcctgcgtgcagcgctggccctgcctctacgtggacatctcccagggccgtgggaagaagtggtggactctgcgcagggcctgcttcaagattgtcgagcacaactggttcgagaccttcattgtcttcatgatcctgctcagcagtggggctctggccttcgaggacatctacattgagcagcggcgagtcattcgcaccatcctagaatatgccgacaaggtcttcacctacatcttcatcatggagatgctgctcaaatgggtggcctacggctttaaggtgtacttcaccaacgcctggtgctggctcgacttcctcatcgtggatgtctccatcatcagcttggtggccaactggctgggctactcggagctgggacccatcaaatccctgcggacactgcgggccctgcgtcccctgagggcactgtcccgattcgagggcatgagggtggtggtgaacgccctcctaggcgccatcccctccatcatgaatgtgctgcttgtctgcctcatcttctggctgatcttcagcatcatgggtgtcaacctgtttgccggcaagttctactactgcatcaacaccaccacctctgagaggttcgacatctccgaggtcaacaacaagtctgagtgcgagagcctcatgcacacaggccaggtccgctggctcaatgtcaaggtcaactacgacaacgtgggtctgggctacctctccctcctgcaggtggccaccttcaagggttggatggacatcatgtatgcagccgtggactcccgggagaaggaggagcagccgcagtacgaggtgaacctctacatgtacctctactttgtcatcttcatcatctttggctccttcttcaccctcaacctcttcattggcgtcatcattgacaacttcaaccagcagaagaagaagatgagggggaaagacatctttatgacggaggaacagaagaaatactataacgccatgaagaagcttggctccaagaagcctcagaagccaattccccggccccagaacaagatccagggcatggtgtatgacctcgtgacgaagcaggccttcgacatcaccatcatgatcctcatctgcctcaacatggtcaccatgatggtggagacagacaaccagagccagctcaaggtggacatcctgtacaacatcaacatgatcttcatcatcatcttcacaggggagtgcgtgctcaagatgctcgccctgcgccagtactacttcaccgttggctggaacatctttgacttcgtggtcgtcatcctgtccattgtgggccttgccctctctgacctgatccagaagtacttcgtgtcacccacgctgttccgtgtgatccgcctggcgcggattgggcgtgtcctgcggctgatccgcggggccaagggcatccggacgctgctgttcgccctcatgatgtcgctgcctgccctcttcaacatcggcctcctcctcttcctggtcatgttcatctactccatcttcggcatgtccaactttgcctacgtcaagaaggagtcgggcatcgatgatatgttcaacttcgagaccttcggcaacagcatcatctgcctgttcgagatcaccacgtcggccggctgggacgggctcctcaaccccatcctcaacagcgggcccccagactgtgaccccaacctggagaacccgggcaccagtgtcaagggtgactgcggcaacccctccatcggcatctgcttcttctgcagctatatcatcatctccttcctcatcgtggtcaacatgtacatcgccatcatcctggagaacttcaatgtggccacagaggagagcagcgagccccttggtgaagatgactttgagatgttctacgagacatgggagaagttcgaccccgacgccacccagttcatcgcctacagccgcctctcagacttcgtggacaccctgcaggaaccgctgaggattgccaagcccaacaagatcaagctcatcacactggacttgcccatggtgccaggggacaagatccactgcctggacatcctctttgccctgaccaaagaggtcctgggtgactctggggaaatggacgccctcaagcagaccatggaggagaagttcatggcagccaacccctccaaggtgtcctacgagcccatcaccaccaccctcaagaggaagcacgaggaggtgtgcgccatcaagatccagagggcctaccgccggcacctgctacagcgctccatgaagcaggcatcctacatgtaccgccacagccacgacggcagcggggatgacgcccctgagaaggaggggctgcttgccaacaccatgagcaagatgtatggccacgagaatgggaacagcagctcgccaagcccggaggagaagggcgaggcaggggacgccggacccactatggggctgatgcccatcagcccctcagacactgcctggcctcccgcccctcccccagggcagactgtgcgcccaggtgtcaaggagtctcttgtctagcaggcagcatcggggtggcccactgagtctcggcatagtccccagagctcccccgtggtgcctgcacacagagtgagggaggagggctttgaatctgggactgtgcctggctccctgatgggggacaggatttggccacactggggctgacacccaggcccgagcgcctgcgttcccagaccatgggaaatgggaattgcgctcaggggctccatgctgggtctgaggcccctgcctccaagatttaacctgcaagttgctctgacctcctctgggccctgtcgcccctccttttggcctgggggaggtcagaacattcgaatctctgcccctcacttgaggaggagctggcctgcggtggagggatcagttgccccccatcaccagagtcttaagggtcactggcctctccccaggaagtggctcagacccctcagccccagcccagacaaagatgtcttaacctcagggagtgcagacacctaaccccagggcactgccagcccaccccctttgactctggggtgcagcttcacccaccaggccagctcaggaattccctggaaaagggaaatgtgactggttcagaaatagctcctcaaagcctcaaaacctgattggccactggatcctgctgctttgggctgggatggtgactcctgaaacctcttcctaggccacgtccaggtccgtagctcccctggctggctcctaggggaagagcagaaggaaggatgccacttgggaatgaattgtccttttctaggaagcacgggggagtgagacaggctgggtcctgccagctggatcgctgcacatggcctgagcatccagacctgagcgggagtcagggacctgctgctcagtaagaagattctcgccccttccctctctccctgcctcactcctccgtgagcaccaccagggctccaggagcctcatccagcctcagagatctcccttctcatctccccacgcccgtctctttctcacctttcccacctctctccccaaagtgatcctaagaatgtacagttgagctcaggttagatatttcgaccctggggcgtgcagcagggaaggcccaactggttcaggctcaaccttccaacttcctgtggcctgaagaagcacttctgctgcatcgctgttctgggcatggcagggccaggcctctgctggctcaggaggaggggtgagagacctgctcaggcgtcgctggatttattcacttgtgtgtgtacctgtggctgtgtgtctgcttgtatgcttttataggcctgtgtgtatagctgtgtgtgtgttcaagtgcgtgactgtatgtgtgtgtgtgaaccactgtgtactggagcctgcattatgcacgtgtctgggtatctttgtatatatgtgtatatatgtgtgccctggactgtttcaaggtccatggagtacggctggtgtgtcatactgtgcaggcctgtccctgggagtgttcccgtgcctgggagagtggacctgtgctgtgagtgtgtggatgcgtgtgaacgcatgtggtaaggtgtgtactcagggcattctgttggcctaagtgcctcttctttttcttcttgtttctcatgaaaagtttgattaaaattcaggaagcagcaaaaccttcaaaacaagacatgtatgtgtgcttgagtgtgtgaacacgtgtgtgtgtgtgcacatctacatgccatgcctatgggccagagttgtctttattgtccaccatgctctctcacctgctcccagtcctgcctgaacagccctctctctcactcccctctcctccccttcctgtttctcgttgtcacacccatggcctcagccctgctccctgcctcctgcctatgtctcctctatggaaggaggcctccactccttccatctcttccttcagaagtttcgtctaatgggggcagtctccccttcctggcacattgcccctctgccttgccctcctgggccctgggctggcacagcccctggagcctcagaaatctgtttgattggatattctcctcggactgtgtgcaggttgcagaggaagagtagatgagccgggtccggcctctccctgcctgtggcccctcccctgcagacggatgcccattcctgcctggtccagtggggaacaggtcccacgccaggccagcaggcgggctcctttgtacagttcttacaataaaccctccttggtgcctctgg

SEQ ID NO: 182682 - DNA, 4484 bp, Homo sapiens
  Payload ID: 15996
  Gene Symbol: SCN4B
  Gene Name: sodium channel, voltage gated, type IV beta subunit
  Uniprot ID: Q8IWT1
  ENST ID: ENST00000324727
  CDS Start-End: 148-834
ctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttgggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaacaacatttccattgtgctgagggacctggagttcagcgacacgggcaaatacacctgccatgtgaagaaccccaaggagaataatctccagcaccacgccaccatcttcctccaagtcgttgatagactggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggggaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctcccccccccccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaataa

SEQ ID NO: 182683 - DNA, 566 bp, Homo sapiens
  Payload ID: 15996
  Gene Symbol: SCN4B
  Gene Name: sodium channel, voltage gated, type IV beta subunit
  Uniprot ID: Q8IWT1
  ENST ID: ENST00000529878
  CDS Start-End: 216-500
agcagccggctcccagcagcgggcgagcgcgcctccccctccgctccctccctccccctcctctcgctctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttggtggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccc

SEQ ID NO: 182684 - DNA, 9786 bp, Homo sapiens
  Payload ID: 15997
  Gene Symbol: SCN9A
  Gene Name: sodium channel, voltage gated, type IX alpha subunit
  Uniprot ID: Q15858
  ENST ID: ENST00000303354
  CDS Start-End: 342-6308
cggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatac

SEQ ID NO: 182685 - DNA, 9768 bp, Homo sapiens
  Payload ID: 15997
  Gene Symbol: SCN9A
  Gene Name: sodium channel, voltage gated, type IX alpha subunit
  Uniprot ID: Q15858
  ENST ID: ENST00000409672
  CDS Start-End: 348-6281
gggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 182686 - DNA, 5967 bp, Homo sapiens
  Payload ID: 15997
  Gene Symbol: SCN9A
  Gene Name: sodium channel, voltage gated, type IX alpha subunit
  Uniprot ID: Q15858
  ENST ID: ENST00000409435
  CDS Start-End: 1-5967
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatag

SEQ ID NO: 182687 - DNA, 1618 bp, Homo sapiens
  Payload ID: 15997
  Gene Symbol: SCN9A
  Gene Name: sodium channel, voltage gated, type IX alpha subunit
  ENST ID: ENST00000452182
  CDS Start-End: 1-1618
attctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcatatgtgacagagtttgtggacctgggcaatgtctcagcattgagaacattcagagttctccgagcattgaaaacaatttcagtcattccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcggcacgaccaatcaaatacacaagaaaaggcgttgtagttcctatctcc

SEQ ID NO: 182688 - DNA, 1585 bp, Homo sapiens
  Payload ID: 15997
  Gene Symbol: SCN9A
  Gene Name: sodium channel, voltage gated, type IX alpha subunit
  ENST ID: ENST00000454569
  CDS Start-End: 1-1585
attctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcatatgtgacagagtttgtggacctgggcaatgtctcagcattgagaacattcagagttctccgagcattgaaaacaatttcagtcattccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcc

SEQ ID NO: 182689 - DNA, 8456 bp, Homo sapiens
  Payload ID: 15998
  Gene Symbol: SCN5A
  Gene Name: sodium channel, voltage gated, type V alpha subunit
  Uniprot ID: Q14524
  ENST ID: ENST00000333535
  CDS Start-End: 151-6201
gccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttac

SEQ ID NO: 182690 - DNA, 335 bp, Homo sapiens
  Payload ID: 15998
  Gene Symbol: SCN5A
  Gene Name: sodium channel, voltage gated, type V alpha subunit
  ENST ID: ENST00000327956
  CDS Start-End: 139-335
agtggacactgtgggcatgcgtgtccgtgcagcacatcgccatgcaggagcctgggggaaggcctttccctcagtgagggctgcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccaga

SEQ ID NO: 182691 - DNA, 8343 bp, Homo sapiens
  Payload ID: 15998
  Gene Symbol: SCN5A
  Gene Name: sodium channel, voltage gated, type V alpha subunit
  ENST ID: ENST00000451551
  CDS Start-End: 196-6084
gagacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 182692 - DNA, 8362 bp, Homo sapiens
  Payload ID: 15998
  Gene Symbol: SCN5A
  Gene Name: sodium channel, voltage gated, type V alpha subunit
  Uniprot ID: Q14524
  ENST ID: ENST00000423572
  CDS Start-End: 56-6103
cagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 182693 - DNA, 8303 bp, Homo sapiens
  Payload ID: 15998
  Gene Symbol: SCN5A
  Gene Name: sodium channel, voltage gated, type V alpha subunit
  ENST ID: ENST00000414099
  CDS Start-End: 43-6039
ggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtgtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatgacctgg

SEQ ID NO: 182694 - DNA, 7170 bp, Homo sapiens
  Payload ID: 15998
  Gene Symbol: SCN5A
  Gene Name: sodium channel, voltage gated, type V alpha subunit
  ENST ID: ENST00000455624
  CDS Start-End: 26-5977
ctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcagg

SEQ ID NO: 182695 - DNA, 6284 bp, Homo sapiens
  Payload ID: 15998
  Gene Symbol: SCN5A
  Gene Name: sodium channel, voltage gated, type V alpha subunit
  ENST ID: ENST00000450102
  CDS Start-End: 43-5931
ggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgag

SEQ ID NO: 182696 - DNA, 8504 bp, Homo sapiens
  Payload ID: 15998
  Gene Symbol: SCN5A
  Gene Name: sodium channel, voltage gated, type V alpha subunit
  ENST ID: ENST00000413689
  CDS Start-End: 195-6245
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 182697 - DNA, 5898 bp, Homo sapiens
  Payload ID: 15998
  Gene Symbol: SCN5A
  Gene Name: sodium channel, voltage gated, type V alpha subunit
  ENST ID: ENST00000449557
  CDS Start-End: 10-5898
gatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtga

SEQ ID NO: 182698 - DNA, 8450 bp, Homo sapiens
  Payload ID: 15998
  Gene Symbol: SCN5A
  Gene Name: sodium channel, voltage gated, type V alpha subunit
  ENST ID: ENST00000425664
  CDS Start-End: 195-6191
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtgtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatga

SEQ ID NO: 182699 - DNA, 714 bp, Homo sapiens
  Payload ID: 15998
  Gene Symbol: SCN5A
  Gene Name: sodium channel, voltage gated, type V alpha subunit
  ENST ID: ENST00000612060
  CDS Start-End: 43-714
ggcaacgtgaggagagcctgtgcccagaagcaggatgagaagatggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcactcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggctgcctctgtcttgggaactctgttttttccaatgagtattcaggccacctccacctcatga

SEQ ID NO: 182700 - DNA, 7183 bp, Homo sapiens
  Payload ID: 15999
  Gene Symbol: SCN7A
  Gene Name: sodium channel, voltage gated, type VII alpha subunit
  Uniprot ID: Q01118
  ENST ID: ENST00000409855
  CDS Start-End: 128-5176
gtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatatggatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcagtgagtttaaagtgggttaaagtggccatttgacaatctcatatttgttttctctacatggcttatatgatgtgtgccttctagggaatgaagggaagtggtgatagagatcagcagcagcaggggctttcttttatattttatgtataatttaatgggctttaagtcaccactattaagacttacaaataagcaaatactttcctgatgtgggatggtgaaatgctaatggccattaaatcataaacttgcctagacaaaagccaattggaagaagggagagagcagttctttagaaagtgcctttgagatcaacctcagagattcttgggctgattaaaactgcatttgaaaaagattggttgaagctctgtgtttatttttgtatgttcttgttttcatttggaactgggaatgaataggatttcattgtgctcaagctcctggtttctcatctctggatagtttcacctaagctctggctcttaagcaggacagattcgtaaaacaagaagcataaaggagaggtatagccttttttttttttttttttttcattttcttctcatttacacctatttttttaaaaagtatacatttactaaaatgatgtaataaataacatgttaatagactcaagctttaccttatgaaattgatgtatttttaccagttatttctaatgtaacattgaatatataagatctgacaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccaca

SEQ ID NO: 182701 - DNA, 5337 bp, Homo sapiens
  Payload ID: 15999
  Gene Symbol: SCN7A
  Gene Name: sodium channel, voltage gated, type VII alpha subunit
  ENST ID: ENST00000424326
  CDS Start-End: 128-2416
gtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactgggcttgggaggcctcaggaaacttacaatcacggtggaagaggaagcaggcatgtccttcacattgcagcagcaaggagaagtgcagagtgaaggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatatggatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaa

SEQ ID NO: 182702 - DNA, 1459 bp, Homo sapiens
  Payload ID: 15999
  Gene Symbol: SCN7A
  Gene Name: sodium channel, voltage gated, type VII alpha subunit
  ENST ID: ENST00000441411
  CDS Start-End: 253-1459
ctggagagtcgccccagtgagtcggtgtctaactggccatttagtggggcccatttactgcagagccacagctggtgaggacagacgccagcctaacagcagcttctgtacaactagagctcagaaaacccgagagatccgtggagaaagagaagcccaggaggaggaaagggctccaaggagccctgctcctgaagggtccctcaggcactggtggagacctgtcgcttcgtagcaagtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcaga

SEQ ID NO: 182703 - DNA, 2996 bp, Homo sapiens
  Payload ID: 15999
  Gene Symbol: SCN7A
  Gene Name: sodium channel, voltage gated, type VII alpha subunit
  ENST ID: ENST00000419992
  CDS Start-End: 408-2996
ctccactggacatctgggtaggaggggtctctgggtcagtggctggagagtcgccccagtgagtcggtgtctaactggccatttagtggggcccatttactgcagagccacagctggtgaggacagacgccagcctaacagcagcttctgtacaactagagctcagaaaacccgagagatccgtggagaaagagaagcccaggaggaggaaagggctccaaggagccctgctcctgaagggtccctcaggcactggtggagacctgtcgcttcgtagcaagtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaa

SEQ ID NO: 182704 - DNA, 7186 bp, Homo sapiens
  Payload ID: 15999
  Gene Symbol: SCN7A
  Gene Name: sodium channel, voltage gated, type VII alpha subunit
  Uniprot ID: Q01118
  ENST ID: ENST00000619410
  CDS Start-End: 131-5179
caggtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatatggatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcagtgagtttaaagtgggttaaagtggccatttgacaatctcatatttgttttctctacatggcttatatgatgtgtgccttctagggaatgaagggaagtggtgatagagatcagcagcagcaggggctttcttttatattttatgtataatttaatgggctttaagtcaccactattaagacttacaaataagcaaatactttcctgatgtgggatggtgaaatgctaatggccattaaatcataaacttgcctagacaaaagccaattggaagaagggagagagcagttctttagaaagtgcctttgagatcaacctcagagattcttgggctgattaaaactgcatttgaaaaagattggttgaagctctgtgtttatttttgtatgttcttgttttcatttggaactgggaatgaataggatttcattgtgctcaagctcctggtttctcatctctggatagtttcacctaagctctggctcttaagcaggacagattcgtaaaacaagaagcataaaggagaggtatagccttttttttttttttttttttcattttcttctcatttacacctatttttttaaaaagtatacatttactaaaatgatgtaataaataacatgttaatagactcaagctttaccttatgaaattgatgtatttttaccagttatttctaatgtaacattgaatatataagatctgacaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccaca

SEQ ID NO: 182705 - DNA, 7186 bp, Homo sapiens
  Payload ID: 15999
  Gene Symbol: SCN7A
  Gene Name: sodium channel, voltage gated, type VII alpha subunit
  Uniprot ID: Q01118
  ENST ID: ENST00000621965
  CDS Start-End: 131-5179
caggtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccatttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacataaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcaccagatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatatggatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcagtgagtttaaagtgggttaaagtggccatttgacaatctcatatttgttttctctacatggcttatatgatgtgtgccttctagggaatgaagggaagtggtgatagagatcagcagcagcaggggctttcttttatattttatgtataatttaatgggctttaagtcaccactattaagacttacaaataagcaaatactttcctgatgtgggatggtgaaatgctaatggccattaaatcataaacttgcctagacaaaagccaattggaagaagggagagagcagttctttagaaagtgcctttgagatcaacctcagagattcttgggctgattaaaactgcatttgaaaaagattggttgaagctctgtgtttatttttgtatgttcttgttttcatttggaactgggaatgaataggatttcattgtgctcaagctcctggtttctcatctctggatagtttcacctaagctctggctcttaagcaggacagattcgtaaaacaagaagcataaaggagaggtatagccttttttttttttttttttttcattttcttctcatttacacctatttttttaaaaagtatacatttactaaaatgatgtaataaataacatgttaatagactcaagctttaccttatgaaattgatgtatttttaccagttatttctaatgtaacattgaatatataagatctgacaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccaca

SEQ ID NO: 182706 - DNA, 11556 bp, Homo sapiens
  Payload ID: 16000
  Gene Symbol: SCN8A
  Gene Name: sodium channel, voltage gated, type VIII alpha subunit
  Uniprot ID: Q9UQD0
  ENST ID: ENST00000354534
  CDS Start-End: 179-6121
gagcgctccaagatggcgcccaccgcagtcccgcccgccgcatcctcggcgcctttgcagtccggccgcgcctcccgggccccgcgttagggccgccgctgcctccctcgccgccgccgctgccagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctctaacatacagccattgttgcacattttgcaagatgaactatttaatgctgctctgtgtccagtacatgggggagactttgatcccaaatggcttgtactatttatgtcactgtaaaaccaaatcctagggctaaaaaaaaaattcatttgtatcttgcaatatttatgacgatcgtttagccttcatactggagaattgacacttatttggggtagagataaaagtgcttttcaaagtagcaccagttatctctaggggtaatttggggaacttaaaatgacctttcattgggagttatggggtgctcatttcatttcgtatcatgtcctctgcattgtggctttctccaggcatgggtcgataccgcgaggggttcagatattctgaactgacctctctcttctgcagaggggtcatcgcatactcacacactgcatggctccccctgcctccatcacatttctccactgagcagggcttcccttgcccacagaggtgggtgagggtagcagcattggggttacggctgtggtttctttcacttattattagaataatagtcactggtgagacctgaggtagagatggagccgcctctgaaccaagcccacttggtttctttactgcactggttttcatgagaaagcaatttaatattaattctttaggatgttccagcttccctcagtgcattcccttgcagccagttttgctatctgcttagcgacctgcccattgtcattgaagtgtggcttctgggggagcgtcatatcttccattccatctcctgctttaggaaagacagtttttagtccaggggtttctcacctaatgactggatttcaaagccaagatgctgcagttgaatgtgtcaggaagtctctatacaaagagtgaaaagagactttagcatgtgaaccaaatccaaataaattcttcctgaaccatacactagagggggaagaagaaccaacccataatcagacacaccgatctgccttgcagtagaagcactttgaaggtaatttcacagtccaccagactagttttgcatagaacaaaccacagtaagtcggcaagcagagctttctatcttgttggaccactagaaactgtccagctctcttaagcctgcttctgcagcagcatccgtagaatttttgtactacacccaataccagactgggaaggcctatctttcagtgaccctgctaactgctaggatgaatgtatagtaacatgtacaggctacattgtaaacagcacaaaacagaagctgacatgtgtggttattctttttaagagaattataaatactgtaatatataattttattttattggcatgcctttttgtaaatacaaattattaacttattaaataggaaatggcttctggcttatgccattgtcatgtttatttttattttttatacttttctttcttcttagaacttagatgctgtcagccaatgtacatccccaaaccagacagacagacaaaaaattttttattgctaatggtcttttccaaaacaacaaaaaatatatatttttgttccaatgtgcaataaattctaaccacgtctatgcaagatttggctaaacttaataattgttcttaggtcttgagatgggcaacagagctgtaagatcccgccaagtacaccatgtgctcatgctagtgatgtcattaagctactagggcatagtgatgagatttttctgagatctaaccgtttccctccgctagctcctgaccccagcccagcaggctgtctcctcagtaacacatgggccttggtatctggcacccatcagccagcctcataggaaagaagccacctccgctgtatttgaagtttcactttttaaaaaaaaaatgtttcccacctttttatccttcacccactgtccttccacctgctcactcactcactctctcacccatcctgctccacacttctttggtagtaaatgacaccatcaccagcagtttacacccgcagttaacaggcatcgaactgaaagaatcagtgatgacgtttttgtgcatcttcgctgagtgggtaagtggcaatgctttgccaaatattaacgaagccaatcaaagagcagcgcagccacagtatcactgcacatatatatatagatatataaatataatataaatatttattttttgtagccaggtccttggtgcagtatttatactccacaatccaccttttaaaaaaaggacaaaaagcaaaaagatgtgtgatgctgttaataatttaaaatgcagagccaaagccactgagcagcagctgacatggttgctggtttgtgtgtgaaaaacattttccccctcttctttccttaacctccttgttgcttaggatgaggagactctgtaatttaaagcagaggacgagaggaggaagaaacttccatgttaacatggcctactctcactcctttctaaacgagccacttttggcgtcagaagttgactggagagagataaacaaactcccagtcaaagcccctaaagcgacagtgcccagagttcttttattttttgctgcaaccaacgtaaacctgtaaaagaccaacagtgaagattagtgtattagtgaatgcatggaggccaatgctgccctaatgagacgtgataaaaagtccatcactcctctaagccaaaaggaaacaaaataaaaatgaccctttttactgtacaagggaagcctgtcttggtgtgtttgttgcttgactatcccaattcttgagtcctgggaggggtctgggaattgggaccttagcacatttggggaaaggaggggaatagagggaagagaaatcaaaggggctctcgcaaagttctggctaagaaggagagattggaagaaaagcaaggtcctgaccccccccagatccccactcacccattgcatgtggcattccccactactggccggtgcttagaggcccataaaacctctcttcacctaatccacctggcagagccctcagagatgacgtcagccaacccagctggactggccttacttctgcctttttcacctgtatgttaaaaaacaaaaacaaaaaaaccctatccctgtgccccaaagctagggcatgtgcgatgcccaacagcctccactctgcaagctcatactgggccctgccctccatcgccccagacaggcccacagacgagggctggtctccttcacatttgtgtgggggtgggggcacgcttcctcttccttctctccctgtccccctttggggacatccctctctaggcctaggccatgtctcctggttcaggaacactctctcaggaggatctcgaagtgcccactctagtccgctccagtagctccactctggagcgagatggctggtaggtcagtccccatcctcctcccctcggcccccagcctccaggcctgctgtggaggtgagatcgccatgggtcatgactttgtgacttgagtcctgggcatcttctgtaatgatgcctctttcttttctcagatgttgcccacagtttagcaaaaagcttcgttcattttcaggtactccccaccccctaaagaattggctgcaacttgccagccagggggacatcaggagagaagaggaagtctgggttgggaggggcccaagttttgcaacagagtttccattgttcagctctgtgctttcttggattccctttccaagattaccaagatttcctccattaaaactcctgaggcaccccctgcccctgccccccactgctgtttgctgtacatagaggctaagtggggtggggtgggtgggtgtgcacatgtggtgtgtgtgtgtgtgtgtgaagaatgtatataggtaaaggggagtgtggtccagtggttccagaaaagggacagaactgtgttctgtccctagcttgaccgctggctcgctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgttccctgttctgtttatgcggaaatggcagaaatgcttgagaaatgagaatgtgtaagtggattggaagtttatagtatgaaatttcaattttactttgtactgtacatctttttactttagaatttgcaataaagggttacgtcaatcttgttttcaactctc

SEQ ID NO: 182707 - DNA, 5820 bp, Homo sapiens
  Payload ID: 16000
  Gene Symbol: SCN8A
  Gene Name: sodium channel, voltage gated, type VIII alpha subunit
  Uniprot ID: Q9UQD0
  ENST ID: ENST00000355133
  CDS Start-End: 1-5820
atggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttag

SEQ ID NO: 182708 - DNA, 11433 bp, Homo sapiens
  Payload ID: 16000
  Gene Symbol: SCN8A
  Gene Name: sodium channel, voltage gated, type VIII alpha subunit
  Uniprot ID: Q9UQD0
  ENST ID: ENST00000545061
  CDS Start-End: 179-5998
gagcgctccaagatggcgcccaccgcagtcccgcccgccgcatcctcggcgcctttgcagtccggccgcgcctcccgggccccgcgttagggccgccgctgcctccctcgccgccgccgctgccagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctctaacatacagccattgttgcacattttgcaagatgaactatttaatgctgctctgtgtccagtacatgggggagactttgatcccaaatggcttgtactatttatgtcactgtaaaaccaaatcctagggctaaaaaaaaaattcatttgtatcttgcaatatttatgacgatcgtttagccttcatactggagaattgacacttatttggggtagagataaaagtgcttttcaaagtagcaccagttatctctaggggtaatttggggaacttaaaatgacctttcattgggagttatggggtgctcatttcatttcgtatcatgtcctctgcattgtggctttctccaggcatgggtcgataccgcgaggggttcagatattctgaactgacctctctcttctgcagaggggtcatcgcatactcacacactgcatggctccccctgcctccatcacatttctccactgagcagggcttcccttgcccacagaggtgggtgagggtagcagcattggggttacggctgtggtttctttcacttattattagaataatagtcactggtgagacctgaggtagagatggagccgcctctgaaccaagcccacttggtttctttactgcactggttttcatgagaaagcaatttaatattaattctttaggatgttccagcttccctcagtgcattcccttgcagccagttttgctatctgcttagcgacctgcccattgtcattgaagtgtggcttctgggggagcgtcatatcttccattccatctcctgctttaggaaagacagtttttagtccaggggtttctcacctaatgactggatttcaaagccaagatgctgcagttgaatgtgtcaggaagtctctatacaaagagtgaaaagagactttagcatgtgaaccaaatccaaataaattcttcctgaaccatacactagagggggaagaagaaccaacccataatcagacacaccgatctgccttgcagtagaagcactttgaaggtaatttcacagtccaccagactagttttgcatagaacaaaccacagtaagtcggcaagcagagctttctatcttgttggaccactagaaactgtccagctctcttaagcctgcttctgcagcagcatccgtagaatttttgtactacacccaataccagactgggaaggcctatctttcagtgaccctgctaactgctaggatgaatgtatagtaacatgtacaggctacattgtaaacagcacaaaacagaagctgacatgtgtggttattctttttaagagaattataaatactgtaatatataattttattttattggcatgcctttttgtaaatacaaattattaacttattaaataggaaatggcttctggcttatgccattgtcatgtttatttttattttttatacttttctttcttcttagaacttagatgctgtcagccaatgtacatccccaaaccagacagacagacaaaaaattttttattgctaatggtcttttccaaaacaacaaaaaatatatatttttgttccaatgtgcaataaattctaaccacgtctatgcaagatttggctaaacttaataattgttcttaggtcttgagatgggcaacagagctgtaagatcccgccaagtacaccatgtgctcatgctagtgatgtcattaagctactagggcatagtgatgagatttttctgagatctaaccgtttccctccgctagctcctgaccccagcccagcaggctgtctcctcagtaacacatgggccttggtatctggcacccatcagccagcctcataggaaagaagccacctccgctgtatttgaagtttcactttttaaaaaaaaaatgtttcccacctttttatccttcacccactgtccttccacctgctcactcactcactctctcacccatcctgctccacacttctttggtagtaaatgacaccatcaccagcagtttacacccgcagttaacaggcatcgaactgaaagaatcagtgatgacgtttttgtgcatcttcgctgagtgggtaagtggcaatgctttgccaaatattaacgaagccaatcaaagagcagcgcagccacagtatcactgcacatatatatatagatatataaatataatataaatatttattttttgtagccaggtccttggtgcagtatttatactccacaatccaccttttaaaaaaaggacaaaaagcaaaaagatgtgtgatgctgttaataatttaaaatgcagagccaaagccactgagcagcagctgacatggttgctggtttgtgtgtgaaaaacattttccccctcttctttccttaacctccttgttgcttaggatgaggagactctgtaatttaaagcagaggacgagaggaggaagaaacttccatgttaacatggcctactctcactcctttctaaacgagccacttttggcgtcagaagttgactggagagagataaacaaactcccagtcaaagcccctaaagcgacagtgcccagagttcttttattttttgctgcaaccaacgtaaacctgtaaaagaccaacagtgaagattagtgtattagtgaatgcatggaggccaatgctgccctaatgagacgtgataaaaagtccatcactcctctaagccaaaaggaaacaaaataaaaatgaccctttttactgtacaagggaagcctgtcttggtgtgtttgttgcttgactatcccaattcttgagtcctgggaggggtctgggaattgggaccttagcacatttggggaaaggaggggaatagagggaagagaaatcaaaggggctctcgcaaagttctggctaagaaggagagattggaagaaaagcaaggtcctgaccccccccagatccccactcacccattgcatgtggcattccccactactggccggtgcttagaggcccataaaacctctcttcacctaatccacctggcagagccctcagagatgacgtcagccaacccagctggactggccttacttctgcctttttcacctgtatgttaaaaaacaaaaacaaaaaaaccctatccctgtgccccaaagctagggcatgtgcgatgcccaacagcctccactctgcaagctcatactgggccctgccctccatcgccccagacaggcccacagacgagggctggtctccttcacatttgtgtgggggtgggggcacgcttcctcttccttctctccctgtccccctttggggacatccctctctaggcctaggccatgtctcctggttcaggaacactctctcaggaggatctcgaagtgcccactctagtccgctccagtagctccactctggagcgagatggctggtaggtcagtccccatcctcctcccctcggcccccagcctccaggcctgctgtggaggtgagatcgccatgggtcatgactttgtgacttgagtcctgggcatcttctgtaatgatgcctctttcttttctcagatgttgcccacagtttagcaaaaagcttcgttcattttcaggtactccccaccccctaaagaattggctgcaacttgccagccagggggacatcaggagagaagaggaagtctgggttgggaggggcccaagttttgcaacagagtttccattgttcagctctgtgctttcttggattccctttccaagattaccaagatttcctccattaaaactcctgaggcaccccctgcccctgccccccactgctgtttgctgtacatagaggctaagtggggtggggtgggtgggtgtgcacatgtggtgtgtgtgtgtgtgtgtgaagaatgtatataggtaaaggggagtgtggtccagtggttccagaaaagggacagaactgtgttctgtccctagcttgaccgctggctcgctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgttccctgttctgtttatgcggaaatggcagaaatgcttgagaaatgagaatgtgtaagtggattggaagtttatagtatgaaatttcaattttactttgtactgtacatctttttactttagaatttgcaataaagggttacgtcaatcttgttttcaactctc

SEQ ID NO: 182709 - DNA, 1627 bp, Homo sapiens
  Payload ID: 16000
  Gene Symbol: SCN8A
  Gene Name: sodium channel, voltage gated, type VIII alpha subunit
  ENST ID: ENST00000551216
  CDS Start-End: 1-1627
tttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcatatgtgacagagtttgtggacctgggcaatgtctcagcgctgagaacattcagggttctccgagctttgaaaactatctctgtaattccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggtgaaaattgataaggcagctaccgatgacagtgctacaactgaggtggaaattaagaagaaaggccctggatctcttt

SEQ ID NO: 182710 - DNA, 5976 bp, Homo sapiens
  Payload ID: 16000
  Gene Symbol: SCN8A
  Gene Name: sodium channel, voltage gated, type VIII alpha subunit
  Uniprot ID: Q9UQD0
  ENST ID: ENST00000599343
  CDS Start-End: 1-5976
atggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcgtatataacagagtttgtaaacctaggcaatgtttcagctctacgcactttcagggtactgagggctttgaaaactatttcggtaatcccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggtgaaaattgataaggcagctaccgatgacagtgctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttag

SEQ ID NO: 182711 - DNA, 465 bp, Homo sapiens
  Payload ID: 16000
  Gene Symbol: SCN8A
  Gene Name: sodium channel, voltage gated, type VIII alpha subunit
  ENST ID: ENST00000546961
  CDS Start-End: 159-161
acagacgagaacactgaggtttggagaggttgttacaccctttttccctcttgtgattggtggtaggaaaatattaagtagaggagagacacagtaaagtgccaagagctctggcactcattacctagatcctcgcgagggtggagtgagcggtcgaaatgctcatgcctactttacagatggacagactgaggatcggaaagactgaggtggcctgggggctgtcagggaggcagcgcctccccgctcctggcagcaggtccctgtgggctgaaacacgagcctccacctgccgctgattgacttctcgttttttcagtgggcccaagatcctgtaaattgagttccctgcgcttttggatgtcagaaacttcactgagcgcggcactgttggggggcaggagaaagagctgacctgtcctggacgcagcataactaacgaagctgctgcaggatgagaagatg

SEQ ID NO: 182712 - DNA, 5943 bp, Homo sapiens
  Payload ID: 16000
  Gene Symbol: SCN8A
  Gene Name: sodium channel, voltage gated, type VIII alpha subunit
  Uniprot ID: Q9UQD0
  ENST ID: ENST00000627620
  CDS Start-End: 1-5943
atggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaaacctttgtagtattaaacagagggaaaactctcttcagatttagtgccacgcctgccttgtacattttaagtccttttaacctgataagaagaatagctattaaaattttgatacattcagtatttagcatgatcattatgtgcactattttgaccaactgtgtattcatgacttttagtaaccctcctgactggtcgaagaatgtggagtacacgttcacagggatttatacatttgaatcactagtgaaaatcattgcaagaggtttctgcatagatggctttacctttttacgggacccatggaactggttagatttcagtgtcatcatgatggcatatgtgacagagtttgtggacctgggcaatgtctcagcgctgagaacattcagggttctccgagctttgaaaactatctctgtaattccaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaacaaatttctacacagttcctggcatgctggaacctttactctgtgggaacagttctgatgctgggcaatgcccagagggataccagtgtatgaaagcaggaaggaaccccaactatggttacacaagttttgacacttttagctgggccttcttggcattatttcgccttatgacccaggactattgggaaaacttgtatcaattgactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggctacaactgaggtggaaattaagaagaaaggccctggatctcttttagtttccatggaccaattagcctcctacgggcggaaggacagaatcaacagtataatgagtgttgttacaaatacactagtagaagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagcaaccttcaaaggctggatggacatcatgtatgcagctgtagattcccggaagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagttcggaggtcaggacatcttcatgaccgaagaacagaagaagtactacaatgccatgaaaaagctgggctcaaagaagccacagaaacctattccccgccccttgaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttag

SEQ ID NO: 182713 - DNA, 6418 bp, Homo sapiens
  Payload ID: 16001
  Gene Symbol: SCN10A
  Gene Name: sodium channel, voltage gated, type X alpha subunit
  Uniprot ID: Q9Y5Y9
  ENST ID: ENST00000449082
  CDS Start-End: 1-5871
atggaattccccattggatccctcgaaactaacaacttccgtcgctttactccggagtcactggtggagatagagaagcaaattgctgccaagcagggaacaaagaaagccagagagaagcatagggagcagaaggaccaagaagagaagcctcggccccagctggacttgaaagcctgcaaccagctgcccaagttctatggtgagctcccagcagaactgatcggggagcccctggaggatctagatccgttctacagcacacaccggacatttatggtgctgaacaaagggaggaccatttcccggtttagtgccactcgggccctgtggctattcagtcctttcaacctgatcagaagaacggccatcaaagtgtctgtccactcgtggttcagtttatttattacggtcactattttggttaattgtgtgtgcatgacccgaactgaccttccagagaaaattgaatatgtcttcactgtcatttacacctttgaagccttgataaagatactggcaagaggattttgtctaaatgagttcacgtacctgagagatccttggaactggctggattttagcgtcattaccctggcatatgttggcacagcaatagatctccgtgggatctcaggcctgcggacattcagagttcttagagcattaaaaacagtttctgtgatcccaggcctgaaggtcattgtgggggccctgattcactcagtgaagaaactggctgatgtgaccatcctcaccatcttctgcctaagtgtttttgccttggtggggctgcaactcttcaagggcaacctcaaaaataaatgtgtcaagaatgacatggctgtcaatgagacaaccaactactcatctcacagaaaaccagatatctacataaataagcgaggcacttctgaccccttactgtgtggcaatggatctgactcaggccactgccctgatggttatatctgccttaaaacttctgacaacccggattttaactacaccagctttgattcctttgcttgggctttcctctcactgttccgcctcatgacacaggattcctgggaacgcctctaccagcagaccctgaggacttctgggaaaatctatatgatcttttttgtgctcgtaatcttcctgggatctttctacctggtcaacttgatcttggctgtagtcaccatggcgtatgaggagcagaaccaggcaaccactgatgaaattgaagcaaaggagaagaagttccaggaggccctcgagatgctccggaaggagcaggaggtgctagcagcactagggattgacacaacctctctccactcccacaatggatcacctttaacctccaaaaatgccagtgagagaaggcatagaataaagccaagagtgtcagagggctccacagaagacaacaaatcaccccgctctgatccttacaaccagcgcaggatgtcttttctaggcctcgcctctggaaaacgccgggctagtcatggcagtgtgttccatttccggtcccctggccgagatatctcactccctgagggagtcacagatgatggagtctttcctggagaccacgaaagccatcggggctctctgctgctgggtgggggtgctggccagcaaggccccctccctagaagccctcttcctcaacccagcaaccctgactccaggcatggagaagatgaacaccaaccgccgcccactagtgagcttgcccctggagctgtcgatgtctcggcattcgatgcaggacaaaagaagactttcttgtcagcagaatacttagatgaacctttccgggcccaaagggcaatgagtgttgtcagtatcataacctccgtccttgaggaactcgaggagtctgaacagaagtgcccaccctgcttgaccagcttgtctcagaagtatctgatctgggattgctgccccatgtgggtgaagctcaagacaattctctttgggcttgtgacggatccctttgcagagctcaccatcaccttgtgcatcgtggtgaacaccatcttcatggccatggagcaccatggcatgagccctaccttcgaagccatgctccagataggcaacatcgtctttaccatattttttactgctgaaatggtcttcaaaatcattgccttcgacccatactattatttccagaagaagtggaatatctttgactgcatcatcgtcactgtgagtctgctagagctgggcgtggccaagaagggaagcctgtctgtgctgcggagcttccgcttgctgcgcgtattcaagctggccaaatcctggcccaccttaaacacactcatcaagatcatcggaaactcagtgggggcactggggaacctcaccatcatcctggccatcattgtctttgtctttgctctggttggcaagcagctcctaggggaaaactaccgtaacaaccgaaaaaatatctccgcgccccatgaagactggccccgctggcacatgcacgacttcttccactctttcctcattgtcttccgtatcctctgtggagagtggattgagaacatgtgggcctgcatggaagttggccaaaaatccatatgcctcatccttttcttgacggtgatggtgctagggaacctggtggtgcttaacctgttcatcgccctgctattgaactctttcagtgctgacaacctcacagccccggaggacgatggggaggtgaacaacctgcaggtggccctggcacggatccaggtctttggccatcgtaccaaacaggctctttgcagcttcttcagcaggtcctgcccattcccccagcccaaggcagagcctgagctggtggtgaaactcccactctccagctccaaggctgagaaccacattgctgccaacactgccagggggagctctggagggctccaagctcccagaggccccagggatgagcacagtgacttcatcgctaatccgactgtgtgggtctctgtgcccattgctgagggtgaatctgatcttgatgacttggaggatgatggtggggaagatgctcagagcttccagcaggaagtgatccccaaaggacagcaggagcagctgcagcaagtcgagaggtgtggggaccacctgacacccaggagcccaggcactggaacatcttctgaggacctggctccatccctgggtgagacgtggaaagatgagtctgttcctcaggtccctgctgagggagtggacgacacaagctcctctgagggcagcacggtggactgcctagatcctgaggaaatcctgaggaagatccctgagctggcagatgacctggaagaaccagatgactgcttcacagaaggatgcattcgccactgtccctgctgcaaactggataccaccaagagtccatgggatgtgggctggcaggtgcgcaagacttgctaccgtatcgtggagcacagctggtttgagagcttcatcatcttcatgatcctgctcagcagtggatctctggcctttgaagactattacctggaccagaagcccacggtgaaagctttgctggagtacactgacagggtcttcacctttatctttgtgttcgagatgctgcttaagtgggtggcctatggcttcaaaaagtacttcaccaatgcctggtgctggctggacttcctcattgtgaatatctcactgataagtctcacagcgaagattctggaatattctgaagtggctcccatcaaagcccttcgaacccttcgcgctctgcggccactgcgggctctttctcgatttgaaggcatgcgggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggcaacctttaaaggctggatggacattatgtatgcagctgttgattcccgggaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagttagggggccaggacatcttcatgacagaggagcagaagaaatactacaatgccatgaagaagttgggctccaagaagccccagaagcccatcccacggcccctgaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactctatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcatggtcaacatgtacattgcagtgattctggagaacttcaatgtggccacggaggagagcactgagcccctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtgagaacactccagcctggatatgttcagttatgatgcgtccttctgctctgtgttaactctttcccattgcagatcacacccagctacagcctcaccaatgcatgccactggtcacaatgtcagaactgggcagggaatgcaactggtaaccacctttgaaaaaaccatcatacacaaataggagtcagaagctaagagcacttccactgtgatttcccttctgaatttcaatatcagatcatgggttctcttactctccagaaaatatcccttgtccttttatttttgttgtaatcagattatatttactgagacaaacttctcaggaccagaacttccaaagatatagaacaagaacattactgaaggtccaaggtagtcctctgtggagcaccatacagagattggcaatattatttaggattttgcatgactgcatgtgagagctgtcggacaactgctctgacccagggtaacacctgtggcctatgtcatgaaaagcctttgagatatccattaaaattaatatttttaaatgtatgtcc

SEQ ID NO: 182714 - DNA, 6500 bp, Homo sapiens
  Payload ID: 16002
  Gene Symbol: SCN11A
  Gene Name: sodium channel, voltage gated, type XI alpha subunit
  Uniprot ID: Q9UI33
  ENST ID: ENST00000302328
  CDS Start-End: 200-5575
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgctgtcagcatcctcaccatcaccatgaaggaacaagaaaaatcacaagagccttgtctcccttgtggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagagtgctcagggtcttcaagttagccaaatcctggccaactttgaacacactaattaagataatcggcaactctgtcggagcccttggaagcctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtacaatgatttctaccttggaaaatcaggagcacattcctttccctccgacgctcttcagaattgtccgcttggctcggattggccgaatcctgaggcttgtccgggctgcacgaggaatcaggactctcctctttgctctgatgatgtcgcttccttctctgttcaacattggtcttctactctttctgattatgtttatctatgccattctgggtatgaactggttttccaaagtgaatccagagtctggaatcgatgacatattcaacttcaagacttttgccagcagcatgctctgtctcttccagataagcacatcagcaggttgggattccctgctcagccccatgctgcgatcaaaagaatcatgtaactcttcctcagaaaactgccacctccctggcatagccacatcctactttgtcagttacattatcatctcctttctcattgttgtcaacatgtacattgctgtgattttagagaacttcaatacagccactgaagaaagtgaggaccctttgggtgaagatgactttgacatattttatgaagtgtgggaaaagtttgacccagaagcaacacaatttatcaaatattctgccctttctgactttgctgatgccttgcctgagcctttgcgtgtcgcaaagccaaataaatatcaatttctagtaatggacttgcccatggtgagtgaagatcgcctccactgcatggatattcttttcgccttcaccgctagggtactcggtggctctgatggcctagatagtatgaaagcaatgatggaagagaagttcatggaagccaatcctctcaagaagttgtatgaacccatagtcaccaccaccaagagaaaggaagaggaaagaggtgctgctattattcaaaaggcctttcgaaagtacatgatgaaggtgaccaagggtgaccaaggtgaccaaaatgacttggaaaacgggcctcattcaccactccagactctttgcaatggagacttgtctagctttggggtggccaagggcaaggtccactgtgactgagccctcacctccacgcctacctcatagcttcacagccttgccttcagcctctgagctccaggggtcagcagcttagtgtatcaacagggagtggattcaccaaattagccattccattttcttttctggctaaaataaatgatatttcaatttcattttaaataatacttacagagatataagataaggctacttgacaaccagtggtactattataataaggaagaagacaccaggaaggactgtaaaaggacataccaattttaggattgaaatagttcaggccgggcgcagtggctcatgcctgtaatcccagcactttgagaggccaaggcaggtggatcacgaggtcaagagatcgagaccatcctggccaacatgatgaaactccgtctctactaaaaatacaaaaattagctgggcatggtggcgtgcgcctgtagtcccagctacttgggaggctgaggcaggagaatcgcttaaacctgggagacggaggttgcagtgagccaagatcgtgccactgcactccagcctggtgacagagtgagactctgtttcaaaaaagaaaagaaaagaaacatggttcaaattatatctaaacaaaaaagaataagaaacaaaaaacacattaaaattttaagttgtattttctatgtttctagatacatcatttttgtttgatattttcctgatgcaagtatgtggtttatcacatgtagctcttttgcatgctaaatgaaaattcaaaacttgccaataaatgaatagcttattgcagacattttttaccaacattaattattttgggtttgtttaaaacctagaggcacaatcttgacttgtcaattactaccctttcacaagctaccatctcagatatatatatatatataaattcaataaagctttctgtttgtgttcc

SEQ ID NO: 182715 - DNA, 5729 bp, Homo sapiens
  Payload ID: 16002
  Gene Symbol: SCN11A
  Gene Name: sodium channel, voltage gated, type XI alpha subunit
  Uniprot ID: Q9UI33
  ENST ID: ENST00000444237
  CDS Start-End: 200-4534
tcctgctatacccacagtggtggtcatctcttctgatcttcacagccaatcagctcccaaggcccctgacctcagctcagcttttgtagatccttatgacaccatcctttaagactggaatcctagggcaggctgttttattcccgcctcctgaggcctttctgaggatctgtggcttgtctctgtcctgagggtgaagatggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgctgtcagcatcctcaccatcaccatgaaggaacaagaaaaatcacaagagccttgtctcccttgtggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagagtgctcagggtcttcaagttagccaaatcctggccaactttgaacacactaattaagataatcggcaactctgtcggagcccttggaagcctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacaggcctatgagctccatcaggagaacaagaagcccacgagccagagagttcaaagtgtggaaattgacatgttctctgaagatgagcctcatctgaccatacaggatccccgaaagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtaagtaaaatcagcagtcagagggactttaagaaccagaagtaagtttgtaaatcttatcattttttgaagtttgttcaaactatccacaaagcagaaaactgggccaagtgtactttctgaaagaatagacaggggtactaatgccattctctactgggaagttgctaggagatagagagtaatttctgttcccttaactcactacacaactgaaatagagttcaataatcatgcagctaatgtattcaatggaaatagacaaaattaaaatgactcagaagtttttgtggtggtaacctgatttattcagataattgagtcaaagttctacctttcctgtgcaactataagccctatgagcattttttagttttaaggatttactgcccatgttttttcctttgttcaaaatccacatgggtgccagatcacaattattgtgcccctgtggcactgctgtgccccctttcaacccctatacaaggccccatggcccactctagattgggctttcaagagtatatcattcagacaatcaaagctttttttctattctatatcccatgttaacttaaaccacagtgtgaactgtgcttgtctcagattctttgaccccgcttaccaaccagcctcattctctaatcagtatatttttcctaatcacacgcagggttaactaaaaggcttataaaagaatacaaaagaaagaaggttattaccatactccttcttataaaacacacacatacacacatcaactttaaaattaaattcttcatggctaaaccataagtgcttactctgggtttttgaagtctggttttaattaaactgttaacttgacattttataattatgtaaaactgtccaggagcccttctcatagttcaaaacacaatgaagacaaagaaaactgattttccaaatggaagcttttttgcgatctcagaaagaatgcatcaaacagatatattggatcaagatattttggttcctaatgctactgcagcattgcagatgtttcagagaacaacaacaaatatgctacagttcatagtgtgttctggtttctaagccatgatgttaatgtagataaagcttatcaatagattcttccatgagtttacagttaagtagacctttaatttttattagtcaattccaatcacaagtcttggtgaaattgacagcagcaaaaaa

SEQ ID NO: 182716 - DNA, 5262 bp, Homo sapiens
  Payload ID: 16002
  Gene Symbol: SCN11A
  Gene Name: sodium channel, voltage gated, type XI alpha subunit
  Uniprot ID: Q9UI33
  ENST ID: ENST00000456224
  CDS Start-End: 1-5262
atggatgacagatgctacccagtaatctttccagatgagcggaatttccgccccttcacttccgactctctggctgcaattgagaagcggattgccatccaaaaggagaaaaagaagtctaaagaccagacaggagaagtaccccagcctcggcctcagcttgacctaaaggcctccaggaagttgcccaagctctatggcgacattcctcgtgagctcataggaaagcctctggaagacttggacccattctaccgaaatcataagacatttatggtgttaaacagaaagaggacaatctaccgcttcagtgccaagcatgccttgttcatttttgggcctttcaattcaatcagaagtttagccattagagtctcagtccattcattgttcagcatgttcattatcggcaccgttatcatcaactgcgtgttcatggctacagggcctgctaaaaacagcaacagtaacaatactgacattgcagagtgtgtcttcactgggatttatatttttgaagctttgattaaaatattggcaagaggtttcattctggatgagttttctttccttcgagatccatggaactggctggactccattgtcattggaatagcgattgtgtcatatattccaggaatcaccatcaaactattgcccctgcgtaccttccgtgtgttcagagctttgaaagcaatttcagtagtttcacgtctgaaggtcatcgtgggggccttgctacgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcctgactataattatacgaattttgacaactttggctggtcttttcttgccatgttccggctgatgacccaagattcctgggagaagctttatcaacagaccctgcgtactactgggctctactcagtcttcttcttcattgtggtcattttcctgggctccttctacctgattaacttaaccctggctgttgttaccatggcatatgaggagcagaacaagaatgtagctgcagagatagaggccaaggaaaagatgtttcaggaagcccagcagctgttaaaggaggaaaaggaggctctggttgccatgggaattgacagaagttcacttacttcccttgaaacatcatattttaccccaaaaaagagaaagctctttggtaataagaaaaggaagtccttctttttgagagagtctgggaaagaccagcctcctgggtcagattctgatgaagattgccaaaaaaagccacagctcctagagcaaaccaaacgactgtcccagaatctatcactggaccactttgatgagcatggagatcctctccaaaggcagagagcactgagtgctgtcagcatcctcaccatcaccatgaaggaacaagaaaaatcacaagagccttgtctcccttgtggagaaaacctggcatccaagtacctcgtgtggaactgttgcccccagtggctgtgcgttaagaaggtcctgagaactgtgatgactgacccgtttactgagctggccatcaccatctgcatcatcatcaacactgtcttcttggccatggagcatcacaagatggaggccagttttgagaagatgttgaatatagggaatttggttttcactagcatttttatagcagaaatgtgcctaaaaatcattgcgctcgatccctaccactactttcgccgaggctggaacatttttgacagcattgttgctcttctgagttttgcagatgtaatgaactgtgtacttcaaaagagaagctggccattcttgcgttccttcagagtgctcagggtcttcaagttagccaaatcctggccaactttgaacacactaattaagataatcggcaactctgtcggagcccttggaagcctgactgtggtcctggtcattgtgatctttattttctcagtagttggcatgcagctttttggccgtagcttcaattcccaaaagagtccaaaactctgtaacccgacaggcccgacagtctcatgtttacggcactggcacatgggggatttctggcactccttcctagtggtattccgcatcctctgcggggaatggatcgaaaatatgtgggaatgtatgcaagaagcgaatgcatcatcatcattgtgtgttattgtcttcatattgatcacggtgataggaaaacttgtggtgctcaacctcttcattgccttactgctcaattcctttagcaatgaggaaagaaatggaaacttagaaggagaggccaggaaaactaaagtccagttagcactggatcgattccgccgggctttttgttttgtgagacacactcttgagcatttctgtcacaagtggtgcaggaagcaaaacttaccacagcaaaaagaggtggcaggaggctgtgctgcacaaagcaaagacatcattcccctggtcatggagatgaaaaggggctcagagacccaggaggagcttggtatactaacctctgtaccaaagaccctgggcgtcaggcatgattggacttggttggcaccacttgcggaggaggaagatgacgttgaattttctggtgaagataatgcacagcgcatcacacaacctgagcctgaacaacagaagtctgatgttaccagtatactatcagaatgtagcaccattgatcttcaggatggctttggatggttacctgagatggttcccaaaaagcaaccagagagatgtttgcccaaaggctttggttgctgctttccatgctgtagcgtggacaagagaaagcctccctgggtcatttggtggaacctgcggaaaacctgctaccaaatagtgaaacacagctggtttgagagctttattatctttgtgattctgctgagcagtggggcactgatatttgaagatgttcaccttgagaaccaacccaaaatccaagaattactaaattgtactgacattatttttacacatatttttatcctggagatggtactaaaatgggtagccttcggatttggaaagtatttcaccagtgcctggtgctgccttgatttcatcattgtgattgtctctgtgaccaccctcattaacttaatggaattgaagtccttccggactctacgagcactgaggcctcttcgtgcgctgtcccagtttgaaggaatgaaggtggtggtcaatgctctcataggtgccatacctgccattctgaatgttttgcttgtctgcctcattttctggctcgtattttgtattctgggagtatacttcttttctggaaaatttgggaaatgcattaatggaacagactcagttataaattataccatcattacaaataaaagtcaatgtgaaagtggcaatttctcttggatcaaccagaaagtcaactttgacaatgtgggaaatgcttacctcgctctgctgcaagtggcaacatttaagggctggatggatattatatatgcagctgttgattccacagagaaagaacaacagccagagtttgagagcaattcactcggttacatttacttcgtagtctttatcatctttggctcattcttcactctgaatctcttcattggcgttatcattgacaacttcaaccaacagcagaaaaagttaggtggccaagacatttttatgacagaagaacagaagaaatactataatgcaatgaaaaaattaggatccaaaaaacctcaaaaacccattccacggcctctgaacaaatgtcaaggtctcgtgttcgacatagtcacaagccagatctttgacatcatcatcataagtctcattatcctaaacatgattagcatgatggctgaatcatacaaccaacccaaagccatgaaatccatccttgaccatctcaactgggtctttgtggtcatctttacgttagaatgtctcatcaaaatctttgctttgaggcaatactacttcaccaatggctggaatttatttgactgtgtggtcgtgcttctttccattgttagtacaatgatttctaccttggaaaatcaggagcacattcctttccctccgacgctcttcagaattgtccgcttggctcggattggccgaatcctgaggcttgtccgggctgcacgaggaatcaggactctcctctttgctctgatgatgtcgcttccttctctgttcaacattggtcttctactctttctgattatgtttatctatgccattctgggtatgaactggttttccaaagtgaatccagagtctggaatcgatgacatattcaacttcaagacttttgccagcagcatgctctgtctcttccagataagcacatcagcaggttgggattccctgctcagccccatgctgcgatcaaaagaatcatgtaactcttcctcagaaaactgccacctccctggcatagccacatcctactttgtcagttacattatcatctcctttctcattgttgtcaacatgtacattgctgtgattttagagaacttcaatacagccactgaagaaagtgaggaccctttgggtgaagatgactttgacatattttatgaagtgtgggaaaagtttgacccagaagcaacacaatttatcaaatattctgccctttctgactttgctgatgccttgcctgagcctttgcgtgtcgcaaagccaaataaatatcaatttctagtaatggacttgcccatggtgagtgaagatcgcctccactgcatggatattcttttcgccttcaccgctagggtactcggtggctctgatggcctagatagtatgaaagcaatgatggaagagaagttcatggaagccaatcctctcaagaagttgtatgaacccatagtcaccaccaccaagagaaaggaagaggaaagaggtgctgctattattcaaaaggcctttcgaaagtacatgatgaaggtgaccaagggtgaccaaggtgaccaaaatgacttggaaaacgggcctcattcaccactccagactctttgcaatggagacttgtctagctttggggtggccaagggcaaggtccactgtgactga

SEQ ID NO: 182717 - DNA, 6818 bp, Homo sapiens
  Payload ID: 16003
  Gene Symbol: NALCN
  Gene Name: sodium leak channel, non selective
  Uniprot ID: Q8IZF0
  ENST ID: ENST00000251127
  CDS Start-End: 83-5299
ccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcaagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaacttcgcaagtctgttttcagcatcagggcaaggaaccttctggaaaaggagaccgcagtcactaaaatcttaagagcttgcacccgacagcgcatgctgagcggatcatttgaggggcagcccgcaaaggagaggtcaatcctcagcgtgcagcatcatatccgccaagagcgcaggtcactaagacatggatcaaacagccagaggatcagcaggggaaaatctcttgaaactttgactcaagatcattccaatacagtgagatatagaaatgcacaaagagaagacagtgaaataaagatgattcaggaaaaaaaggagcaagcagagatgaaaaggaaagtgcaagaagaggaactcagagagaaccacccatacttcgataagccactgttcattgtcgggcgagaacacaggttcagaaacttttgccgggtggtggtccgagcacgcttcaacgcatctaaaacagaccctgtcacaggagctgtgaaaaatacaaagtaccatcaactttatgatttgctgggattggtcacttacctggactgggtcatgatcatcgtaaccatctgctcttgcatttccatgatgtttgagtccccgtttcgaagagtcatgcatgcacctactttgcagattgctgagtatgtgtttgtgatattcatgagcattgagcttaatctgaagattatggcagatggcttatttttcactccaactgctgtcatcagggacttcggtggagtaatggacatatttatatatcttgtgagcttgatatttctttgttggatgcctcaaaatgtacctgctgaatcgggagctcagcttctaatggtccttcggtgcctgagacctctgcgcatattcaaactggtgccccagatgaggaaagttgttcgagaacttttcagcggcttcaaggaaatttttttggtctccattcttttgctgacattaatgctcgtttttgcaagctttggagttcagctttttgctggaaaactggccaagtgcaatgatcccaacattattagaagggaagattgcaatggcatattcagaattaatgtcagtgtgtcaaagaacttaaatttaaaattgaggcctggagagaaaaaacctggattttgggtgccccgtgtttgggcgaatcctcggaactttaatttcgacaatgtgggaaacgctatgctggcgttgtttgaagttctctccttgaaaggctgggtggaagtgagagatgttattattcatcgtgtggggccgatccatggaatctatattcatgtttttgtattcctgggttgcatgattggactgaccctttttgttggagtagttattgctaatttcaatgaaaacaaggggacggctttgctgaccgtcgatcagagaagatgggaagacctgaagagccgactgaagatcgcacagcctcttcatcttccgcctcgcccggataatgatggttttagagctaaaatgtatgacataacccagcatccattttttaagaggacaatcgcattactcgtcctggcccagtcggtgttgctctctgtcaagtgggacgtcgaggacccggtgaccgtacctttggcaacaatgtcagttgttttcaccttcatctttgttctggaggttaccatgaagatcatagcaatgtcgcctgctggcttctggcaaagcagaagaaaccgatacgatctcctggtgacgtcgcttggcgttgtatgggtggtgcttcactttgccctcctgaatgcatatacttacatgatgggcgcttgtgtgattgtatttaggtttttctccatctgtggaaaacatgtaacgctaaagatgctcctcttgacagtggtcgtcagcatgtacaagagcttctttatcatagtaggcatgtttctcttgctgctgtgttacgcttttgctggagttgttttatttggtactgtgaaatatggggagaatattaacaggcatgcaaatttttcttcggctggaaaagctattaccgtactgttccgaattgtcacaggtgaagactggaacaagattatgcatgactgtatggttcagcctccgttttgtactccagatgaatttacatactgggcaacagactgtggaaattatgctggggcacttatgtatttctgttcattttatgtcatcattgcctacatcatgctaaatctgcttgtagccataattgtggagaatttctccttgttttattccactgaggaggaccagcttttaagttacaatgatcttcgccactttcaaataatatggaacatggtggatgataaaagagagggggtgatccccacgttccgcgtcaagttcctgctgcggctactgcgtgggaggctggaggtggacctggacaaggacaagctcctgtttaagcacatgtgctacgaaatggagaggctccacaatggcggcgacgtcaccttccatgatgtcctgagcatgctttcataccggtccgtggacatccggaagagcttgcagctggaggaactcctggcgagggagcagctggagtacaccatagaggaggaggtggccaagcagaccatccgcatgtggctcaagaagtgcctgaagcgcatcagagctaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgagacaagcagccagcagcagctcctgagccccacgctgtcggatcgaggaggaagtcggcaagatgcagccgacgcagggaaaccccagaggaaatttgggcagtggcgtctgccctcagccccaaaaccaataagccattcagtgtcctcagtcaacttacggtttggaggaaggacaaccatgaaatctgtcgtgtgcaaaatgaaccccatgactgacgcggcttcctgcggttctgaagttaagaagtggtggacccggcagctgactgtggagagcgacgaaagtggggatgaccttctggatatttaggtggatgtcaatgtagatgaatttctagtggtggaaaccgttttctaataatgtccttgattgtccagtgagcaatctgtaattgatctataactgaattccagcttgtcacaagatgtttataaattgattttcatcctgccacagaaaggcataagctgcatgtatgatgggttactatcaatcattgctcaaaaaaatttttgtataatgacagtactgataatattagaaatgataccgcaagcaaatgtatatcacttaaaaatgtcatatattctgtctgcgtaaactaaggtatatattcatatgtgctctaatgcagtattatcaccgccccgcaaaagagtgctaagcccaaagtggctgatatttagggtacaggggttatagctttagttcacatctttcccatttccactagaaatatttctcttgagagaatttattatttatgattgatctgaaaaggtcagcactgaacttatgctaaaatgatagtagttttacaaactacagattctgaattttaaaaagtatcttctttttctcgtgttatatttttaaatatacacaagacatttggtgaccagaacaagttgatttctgtcctcagttatgttaatgaaactgttgcctccttctaagaaaattgtgtgtgcaagcaccaggcaaagaaatggactcaggatgcttagcggtttaaaacaaacctgtagataaatcacttgagtgacatagttgcgcaaagatgttaagtttcttaagaaaccttttaataactgagtttagcaaaaagaataaaactatatagctcaatttatttaaaaaaatctttgcatgtgtgatgttatcattggcttcatttcttacccaaggtatgtctgttttgccataaatcagcagagtcatttcattctgggtgatcctaacacaccattgctacgttagatttgaaatgacatctctgttaaaagaatcttctatggaaataatggtgccctgcaaaatcttcctttgaactcacaggttagggatcacacaacttacttaatcgttttttgtttttgttttttttccttatatgtcaatggcccatgtcctccgggaaaattagaaaagcaaaatgattacaaagtgctgttagatttcttgtgctgggccagccaagtagaagtggacttgacttggacctttaactattttattacagattggacatttgctgttcagatgttttttaacagagggattatctcagaatcctgtgacctccaggttgttttataatctatttttctctatttaacattcctcagatagataggcaaataggacattccttctgtgtcacagaagtatcgtggtagtggcagtctacagtttatatgattcattgtaactatgagataaagaacaaccagtcatgtggccaaaaggattagatttgatttgatgttcacttggagtttactttttgtacatacaagataaaataaatattggatttgtaaaataa

SEQ ID NO: 182718 - DNA, 1126 bp, Homo sapiens
  Payload ID: 16003
  Gene Symbol: NALCN
  Gene Name: sodium leak channel, non selective
  Uniprot ID: Q8IZF0
  ENST ID: ENST00000376200
  CDS Start-End: 29-685
gtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccaggactctcactctgacacccaggctggagtgcagtggcatgatctcagcttactgaaacatccatctcccaggttcaagagattctcctgcttcagccccccaagtagctgggactacaggcgtgtgccaccacacccgggtaatttttgtatttttagcagagacagggcttcatcatgttggccaggctggtctcgaactcctgacctcaagagatctgcctgcctcagcctcccaaagtgctgggattaaaggcctgagccaccatgtccagccttatttttaaaaaaaaatttcagttcaatattactgcattttaaagccccacacataagcagaaaaactgtcagcaccattttaccgttactattagcccagacataaatgtagttttactcttagagactcaagaaatatccaaactcaaaataaaacagaaaatgttaattgatttg

SEQ ID NO: 182719 - DNA, 709 bp, Homo sapiens
  Payload ID: 16004
  Gene Symbol: SOGA3
  Gene Name: SOGA family member 3
  ENST ID: ENST00000467753
  CDS Start-End: 679-709
tctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaaattaaagaagctagtgacggatttatcttggaaatacacatactggaaattgatcttaccaccatgagggaagatgcaccagccttctgggttctgtctcagaattgctatataggaggaaatgggcactttaaaaagtacaacttttgcctatgatatgcgatgtaagaagatggctaagaatgaaaatattttctatctagcaattacacttaaaactaaagtgattcataagactacaaaactggcttaggaaggaaggttggcggcggtgaagagggaagaggatgatctagtaatgggctcttccaaatcgcatctggtaggttcatagccatgagtcagccaccaatcgggggcgctgccc

SEQ ID NO: 182720 - DNA, 4077 bp, Homo sapiens
  Payload ID: 16004
  Gene Symbol: SOGA3
  Gene Name: SOGA family member 3
  Uniprot ID: Q5TF21
  ENST ID: ENST00000525778
  CDS Start-End: 747-3590
ccgtgttcgagcggttttgggatcctctgccaagtacgggataagagaatagagcaaggagtttgagcgctgctgccaatcttccatctcgggcgtggctctggcctttttgtctctttatcccgccactccccacccccgtcccccgtccccctccccgccttcttctctttcctcttgaaagtaacctctctttggttacttctaccctatcgtcccttgcaatcccgccttctctcctgcccagttcggtgaggtcagctcatgaacatctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaagtgagcaagttctggatttctaaagggttggggatgaatgatgggcttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggtaagaaagtgtgacatttttctgtatgaattgttttaatttttacttctttttttcatcctgtttgtctcctcttgataaataattggcatactgaatataaaaatggactacatgtctcataattatttctcagtagttcactattattattcaaaagctggacggacattcacaatttggtcacatttccaaaaagtatatacatttgtaaagtatctttgccaggttgcatcaaactaacaagataattttgacatccaataaatatctgaaaaaaaatatg

SEQ ID NO: 182721 - DNA, 3756 bp, Homo sapiens
  Payload ID: 16004
  Gene Symbol: SOGA3
  Gene Name: SOGA family member 3
  ENST ID: ENST00000465909
  CDS Start-End: 447-3281
cagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaagtgagcaagttctggatttctaaagggttggggatgaatgatgggcttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggtaagaaagtgtgacatttttctgtatgaattgttttaatttttacttctttttttcatcctgtttgtctcctcttgataaataattggcatactgaatataaaaatggactacatgtctcataattatttctcagtagttcactattattattcaaaagctggacggacattcacaatttggtcacatttccaaaaagtatatacatttgtaaagtatctttgccaggttgcatcaaactaacaagataattttgacatccaataaatatctg

SEQ ID NO: 182722 - DNA, 11696 bp, Homo sapiens
  Payload ID: 16005
  Gene Symbol: SLC1A2
  Gene Name: solute carrier family 1 (glial high affinity glutamate transporter), member 2
  Uniprot ID: P43004
  ENST ID: ENST00000278379
  CDS Start-End: 284-2008
caccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattt

SEQ ID NO: 182723 - DNA, 11538 bp, Homo sapiens
  Payload ID: 16005
  Gene Symbol: SLC1A2
  Gene Name: solute carrier family 1 (glial high affinity glutamate transporter), member 2
  Uniprot ID: P43004
  ENST ID: ENST00000395750
  CDS Start-End: 172-1869
cgactccgctggacctgggacccccagacgtgggaggatgggggtgacctagtgtcttccagtagggcaatctctggacatctttatctccccagtacctctccagatcctgaagcctggggccagggaggagaggttagatgtcagcagtggaaggacagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaa

SEQ ID NO: 182724 - DNA, 11689 bp, Homo sapiens
  Payload ID: 16005
  Gene Symbol: SLC1A2
  Gene Name: solute carrier family 1 (glial high affinity glutamate transporter), member 2
  Uniprot ID: P43004
  ENST ID: ENST00000395753
  CDS Start-End: 323-2020
aggccagagatttattcgagcttcggcgggggagggagcgcagctgggccgcgtttaggctgcaccacccgcgtgtttcagccgctcgactccgctggacctgggacccccagacgtgggaggatggggtgggtgtgcctgcctgtgagtttgggggtgctggaccaaagtgaacacagatgagtcaactccacccattgtctctgcaagaaaacagctcaaaactcaccccatgaatgagagaggaagatgccaccctttgggactgtctgtaccctggcagaaatggaatgatttatccaaataagcaagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaa

SEQ ID NO: 182725 - DNA, 685 bp, Homo sapiens
  Payload ID: 16005
  Gene Symbol: SLC1A2
  Gene Name: solute carrier family 1 (glial high affinity glutamate transporter), member 2
  ENST ID: ENST00000449068
  CDS Start-End: 87-685
gcgcagctgggccgcgtttaggctgcaccacccgcgtgtttcagccgctcgactccgctggacctgggacccccagacgtgggaggatgggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgagga

SEQ ID NO: 182726 - DNA, 607 bp, Homo sapiens
  Payload ID: 16005
  Gene Symbol: SLC1A2
  Gene Name: solute carrier family 1 (glial high affinity glutamate transporter), member 2
  ENST ID: ENST00000464522
  CDS Start-End: 1-276
acttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagtt

SEQ ID NO: 182727 - DNA, 597 bp, Homo sapiens
  Payload ID: 16005
  Gene Symbol: SLC1A2
  Gene Name: solute carrier family 1 (glial high affinity glutamate transporter), member 2
  ENST ID: ENST00000531628
  CDS Start-End: 1-597
tgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatga

SEQ ID NO: 182728 - DNA, 1890 bp, Homo sapiens
  Payload ID: 16005
  Gene Symbol: SLC1A2
  Gene Name: solute carrier family 1 (glial high affinity glutamate transporter), member 2
  Uniprot ID: P43004
  ENST ID: ENST00000606205
  CDS Start-End: 105-1796
taaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtacatttcccattcatggatatcgagacttgtatatagtagtgcatgcttgatttctttaaaaaaaaaaaaaccgtaaagccctgcatgtattattgtcacatttattttcctaaagaatcatgtaacccaa

SEQ ID NO: 182729 - DNA, 4170 bp, Homo sapiens
  Payload ID: 16006
  Gene Symbol: SLC1A3
  Gene Name: solute carrier family 1 (glial high affinity glutamate transporter), member 3
  Uniprot ID: P43003
  ENST ID: ENST00000265113
  CDS Start-End: 477-2105
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaa

SEQ ID NO: 182730 - DNA, 3652 bp, Homo sapiens
  Payload ID: 16006
  Gene Symbol: SLC1A3
  Gene Name: solute carrier family 1 (glial high affinity glutamate transporter), member 3
  Uniprot ID: P43003
  ENST ID: ENST00000381918
  CDS Start-End: 96-1589
ttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 182731 - DNA, 566 bp, Homo sapiens
  Payload ID: 16006
  Gene Symbol: SLC1A3
  Gene Name: solute carrier family 1 (glial high affinity glutamate transporter), member 3
  ENST ID: ENST00000513646
  CDS Start-End: 247-566
acactgcaaccttgaggtctggtattgtggctctccagtccttgattcctgctgagattatgcaatttgccaagagcttgcctggtgtggagcagcactgatttctcacccctggaggctataactcatgtctctttttctcccattctagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagg

SEQ ID NO: 182732 - DNA, 540 bp, Homo sapiens
  Payload ID: 16006
  Gene Symbol: SLC1A3
  Gene Name: solute carrier family 1 (glial high affinity glutamate transporter), member 3
  ENST ID: ENST00000505202
  CDS Start-End: 221-540
ggtgtctgtttatgccgggtccgctgttaattcggagttgagtcattcggggtggattgggggcagattgtggcgcgagatctagaaaaggatcaaggttgagcggatctgcttaaaagtgactgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacagg

SEQ ID NO: 182733 - DNA, 784 bp, Homo sapiens
  Payload ID: 16006
  Gene Symbol: SLC1A3
  Gene Name: solute carrier family 1 (glial high affinity glutamate transporter), member 3
  ENST ID: ENST00000513903
  CDS Start-End: 481-784
aaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagtcatttgcgaggagtcctttggtttccagttacctcccccacaggcgcacacgctggctgcttgcgttggcagcgacacacatccatgttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatct

SEQ ID NO: 182734 - DNA, 4030 bp, Homo sapiens
  Payload ID: 16006
  Gene Symbol: SLC1A3
  Gene Name: solute carrier family 1 (glial high affinity glutamate transporter), member 3
  ENST ID: ENST00000613445
  CDS Start-End: 477-1967
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 182735 - DNA, 3832 bp, Homo sapiens
  Payload ID: 16006
  Gene Symbol: SLC1A3
  Gene Name: solute carrier family 1 (glial high affinity glutamate transporter), member 3
  ENST ID: ENST00000612708
  CDS Start-End: 477-1769
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 182736 - DNA, 1306 bp, Homo sapiens
  Payload ID: 16007
  Gene Symbol: SLC1A7
  Gene Name: solute carrier family 1 (glutamate transporter), member 7
  Uniprot ID: O00341
  ENST ID: ENST00000371491
  CDS Start-End: 169-645
ctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggcagaaagaagaaagttggaggaacggaccaaagggtcctggctgaatgggcacctccttaagagttttccaggaatcaccacccaacgacttccactcacctctcgatggccaccccattagcaagagaatcagagcttgatggcaggtcccatttggtccccacaacataataggacttctgttaaggaaggacgggagaatggagactgcataggcaactagctgtccctgccaaggcccacatttaaaatgattgtaattgtaaaggaagttgtaaagaaatgtctatataggtataagttccatttggcttcttacgagcttccaaatgttctccgtgtgtgtaaactgagtcttgaaagaggggaagagggttaccgaggacaagagtgagtgggaggcgacccaggtggaggcagtgtgagtgtggggcggcaggttggaggaagagcaggcatgcaacggaagcctcttaccagatgctcacctcagagttggcatttctcacaagacacactcctagaaggggactgtgaagacaaagatacaaatgcttttagagaaaggttgctgccaggaccatgtgagggtgcccatctcaccaaacctcccacattgtgcactgtcatttgaaaaatactttgtcagtttgacaggtggaaatatcttgaatttgttgatgaaactaaacattttaaaaagca

SEQ ID NO: 182737 - DNA, 2637 bp, Homo sapiens
  Payload ID: 16007
  Gene Symbol: SLC1A7
  Gene Name: solute carrier family 1 (glutamate transporter), member 7
  Uniprot ID: O00341
  ENST ID: ENST00000371494
  CDS Start-End: 129-1811
ctggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagtgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttca

SEQ ID NO: 182738 - DNA, 2873 bp, Homo sapiens
  Payload ID: 16007
  Gene Symbol: SLC1A7
  Gene Name: solute carrier family 1 (glutamate transporter), member 7
  ENST ID: ENST00000620347
  CDS Start-End: 184-2043
aggattgtggcttccctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccaggaagaaccaagtgagagcactgcagtgcccgcggtccttacctcctgccggagcagcgctgcagaggcacaaacactcctggcggggtggctgcctggggaggggtgagcttcccgacagaggccccagccatcctggaggagggtgctgggcagacaccggcccctctaaccgtagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagtgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttcacttc

SEQ ID NO: 182739 - DNA, 3378 bp, Homo sapiens
  Payload ID: 16007
  Gene Symbol: SLC1A7
  Gene Name: solute carrier family 1 (glutamate transporter), member 7
  ENST ID: ENST00000620288
  CDS Start-End: 173-649
ttccctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaacaacccttggccctgacttctctctgggtggggtgtcacccaccagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggtatgtgctgcccacctgcccagcagtgccgtggagccgggcccccagcccctcccagcagcctgctcctccacctcttactgaggtctggggagaatgctggagaggtttactgtgaaaaactggaaatattcaccacacctgtttatttaaatccttcgcctccccaccccaccccaggggcttccccctggcacctccccctcaggcccgtctgggccatttcttaggcccgcagctggcatccctgccacacccttccctttgctgccctcctctgggatgccaggcccctcacctatgcaagccccttggaggcccgcaccttggtttttaaattttgtgttatttttcttaaagatgggtcccaaattatacaagcttcagaccccacaaagcctgtggaaatgtcctgcctgccatccccgactcctccactgggttttcttgtcaaggaaaagacctcaccaacctcgttcatgcaaaaactctaggggtgactttctacctcgtcctctgccttggcccccacctttgcatccggtcgggtctgcccccaaagtcccctccaagccgtgcgtttccttctaccccgcgtcactgcccgggtcaaggccgtgtggtctctcgcctggttcctgtgaaagctgcctagaaaacttccacggctgtccctgctggtgtgtccagctcaggaggtcacaagtctgaccgtgctctgcccattgcccctggaaaggggccgaacccctagtgccggctgaaaagccccgtgagactggcccgtgtgctcctctccgcacaaccctcagcccggctgctcttgccactccccctccacgtttgtcatcttcagggtgctccccacaagtgccatgccctcaggagagtcctccgcagactaggccgagtgccccgagctacactgcctggttactctgtgagcactagactcgattgcaaggatatcattgcttgctgtctgcacagccatgaccagccccatacaggctgacgggcttgtctccatccaccccagagcccaccgctgccgtggctacagcaggcactcagcagacctggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagtgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttc

SEQ ID NO: 182740 - DNA, 2499 bp, Homo sapiens
  Payload ID: 16007
  Gene Symbol: SLC1A7
  Gene Name: solute carrier family 1 (glutamate transporter), member 7
  ENST ID: ENST00000611397
  CDS Start-End: 184-1602
aggattgtggcttccctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccaggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagacctgtttcccttcaccagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagtgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttcacttc

SEQ ID NO: 182741 - DNA, 4561 bp, Homo sapiens
  Payload ID: 16008
  Gene Symbol: SLC1A4
  Gene Name: solute carrier family 1 (glutamate/neutral amino acid transporter), member 4
  Uniprot ID: P43007
  ENST ID: ENST00000234256
  CDS Start-End: 244-1842
ctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaa

SEQ ID NO: 182742 - DNA, 1217 bp, Homo sapiens
  Payload ID: 16008
  Gene Symbol: SLC1A4
  Gene Name: solute carrier family 1 (glutamate/neutral amino acid transporter), member 4
  Uniprot ID: P43007
  ENST ID: ENST00000531327
  CDS Start-End: 265-969
agctgcctggcgggcgacccagccccatcctgatggccccaggacacaagcccaggagcgccccggtgcgcgcggttccgcggcccaggggcgccgggtttggtggcacagcgagccccctttctctagcgaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtgctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacacca

SEQ ID NO: 182743 - DNA, 1719 bp, Homo sapiens
  Payload ID: 16009
  Gene Symbol: SLC1A6
  Gene Name: solute carrier family 1 (high affinity aspartate/glutamate transporter), member 6
  Uniprot ID: P48664
  ENST ID: ENST00000221742
  CDS Start-End: 9-1703
gatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctg

SEQ ID NO: 182744 - DNA, 1794 bp, Homo sapiens
  Payload ID: 16009
  Gene Symbol: SLC1A6
  Gene Name: solute carrier family 1 (high affinity aspartate/glutamate transporter), member 6
  ENST ID: ENST00000430939
  CDS Start-End: 131-1633
actggcatcctgactccttgagaaagagcccatctagcatccttctcgccgttgcttccagcaacatggcccttcttccagctttaggatgtcctaagcgcttccagctgtccaggtcacactctgtcgcatgtcgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctgcccccccagagaggagggaagggggctggggaggggagtcctggtgacacatctgttgcccaactgaccgtgggctgaacacacgttctgcttgactcatttaggggggagggaaaagtgaaataaaggagcaggaatgaaaggt

SEQ ID NO: 182745 - DNA, 2420 bp, Homo sapiens
  Payload ID: 16009
  Gene Symbol: SLC1A6
  Gene Name: solute carrier family 1 (high affinity aspartate/glutamate transporter), member 6
  Uniprot ID: P48664
  ENST ID: ENST00000544886
  CDS Start-End: 794-1732
cttcgcgctggcacggagcatttccagcctcacgcgctttaattttctcagctttaattttctgtggggtcggccaagccatcttccttgtttagcggaggaagccaggctcagagagggagaggagttggcccaagggcacacagcagccaagtggccaaggccggaaggtgcacccgcaaggagaagggggcagcggagccctctccctggctgttgttactgggacactagagccgcgccttccccaggcctccgccgaggctgctggagcgggtcccgcggtgccagggcctgttccccgcgctccgccagggatgctggggcctccgagggctccggaggcggtttagggggcgggggcgcggaggcgcggctccgagcagggggcgggggctggatgccggagaggccactcacccccgcccacccccagtccccctcccttcgcaagcacgctgtcccccttctcccacacggctgcggagcctgggctgggcgcgggggaggcggagggcatcgcggaggggatcccgccccctcccccggccgctcggtgcccccacacccacgtgagcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtgagtcctggtctgtgcccacgggatggtggagccagagctgggaagtcaggctgtggggaagctgccgaagggcttgctggggacttttggtcattcatttacgtattgggtgattcacttacccactcaccaactcattcattcatgtctttctgggatgatttcatcactagttgacttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgcaacataa

SEQ ID NO: 182746 - DNA, 424 bp, Homo sapiens
  Payload ID: 16009
  Gene Symbol: SLC1A6
  Gene Name: solute carrier family 1 (high affinity aspartate/glutamate transporter), member 6
  ENST ID: ENST00000595863
  CDS Start-End: 95-424
gtccacctcatgcccgatgttcttgcagttgaggccccagctgaggttcttgtgcgtggcgagcagctcgtccaggttcttttccagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctcc

SEQ ID NO: 182747 - DNA, 1735 bp, Homo sapiens
  Payload ID: 16009
  Gene Symbol: SLC1A6
  Gene Name: solute carrier family 1 (high affinity aspartate/glutamate transporter), member 6
  ENST ID: ENST00000600144
  CDS Start-End: 275-1735
agaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctgctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtga

SEQ ID NO: 182748 - DNA, 566 bp, Homo sapiens
  Payload ID: 16009
  Gene Symbol: SLC1A6
  Gene Name: solute carrier family 1 (high affinity aspartate/glutamate transporter), member 6
  ENST ID: ENST00000601761
  CDS Start-End: 345-566
acattttctgagcaggaaacccaagagacagggttttacgctgtcacccaagttggagtgcagtgcaaggagaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggtgagctctgcctcttg

SEQ ID NO: 182749 - DNA, 695 bp, Homo sapiens
  Payload ID: 16009
  Gene Symbol: SLC1A6
  Gene Name: solute carrier family 1 (high affinity aspartate/glutamate transporter), member 6
  ENST ID: ENST00000597262
  CDS Start-End: 214-695
gcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaagga

SEQ ID NO: 182750 - DNA, 2987 bp, Homo sapiens
  Payload ID: 16009
  Gene Symbol: SLC1A6
  Gene Name: solute carrier family 1 (high affinity aspartate/glutamate transporter), member 6
  Uniprot ID: P48664
  ENST ID: ENST00000598504
  CDS Start-End: 1361-2299
gcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgggatgtaagaggctccgagaagcagcccacacatctcatcagatctaagtgtctagaggtcgggagaaccaagtgggaaagacccaccctcacccctcaccctgtagaaactgggaacactagaagggacattttctgagcaggaaacccaagagacagggttttacgctgtcacccaagttggagtgcagtggtacgatcatagctcattgcagcctcaaactcctgggttcaagcgatcctcctgctttagcctcttgagtggctaggactacaggcacaggccaccgtgcctggctaatttttaatttttaaaaaagagacagggtctggctatgttgcccaggctggccatgaactcctgggctcaagcggttctccagccttcacctcccaaagtgttgggattgcaggcatgagccactgcgtctggcccacagatgctaagtgctgtctgctcttctccaggggtcagcaaattttttcagcaaatggcccaagagtaaacattttgagctttgtggcccgtacaatctctgtcccaacaactcaactcaggcattgtagcttgaaagcagctgtagacaataggtaatgcatgagtgtggctgtgtgccaataaaactttatttacaaaaacaagcagtaggctgaatttgactagcagaccatagtttgtcaataccgtattatgtcttgtaaggaagagaaaggaaccggacaaaactctagcctcgggagttttcctgactgttcagatcttagctgaatgatctcccttggtatctacaggcaacttcctgctgtggcttagggactggaaacataatatcccagagggattccctgtgtagtctgtggttcactctttgggattttttttttttttttttttcacagcaaggagaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtgagtcctggtctgtgcccacgggatggtggagccagagctgggaagtcaggctgtggggaagctgccgaagggcttgctggggacttttggtcattcatttacgtattgggtgattcacttacccactcaccaactcattcattcatgtctttctgggatgatttcatcactagttgacttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgcaacataa

SEQ ID NO: 182751 - DNA, 493 bp, Homo sapiens
  Payload ID: 16009
  Gene Symbol: SLC1A6
  Gene Name: solute carrier family 1 (high affinity aspartate/glutamate transporter), member 6
  ENST ID: ENST00000594383
  CDS Start-End: 388-493
gcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccggtgagtggggactccgcggctcggcgcggggactcggtgtggctgcggcgcggaggttgcgggcaggtgggggatccgaggcgctggggtcaggcgtgtggggcgctccctgcgcccacgtccccacttctccgccgccctttgtctctgagctcctgcttgccccttagagccgttgccaccgcttttctcctggtcgttctgatagaccatgagcagccatggcaacagcctgttcctgcgggagagcggccagcggctgggccgggtgggctggctgcagcggctgcaggaaagcctgcagcagagagcactgc

SEQ ID NO: 182752 - DNA, 592 bp, Homo sapiens
  Payload ID: 16009
  Gene Symbol: SLC1A6
  Gene Name: solute carrier family 1 (high affinity aspartate/glutamate transporter), member 6
  ENST ID: ENST00000599636
  CDS Start-End: 154-592
gctttggaacttggcctaagtgcactggcatcctgactccttgagaaagagcccatctagcatccttctcgccgttgcttccagcaacatggcccttcttccagctttaggatgtcctaagcgcttccagctgtccaggtcacactctgtcgcatgtcgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcg

SEQ ID NO: 182753 - DNA, 3722 bp, Homo sapiens
  Payload ID: 16010
  Gene Symbol: SLC1A1
  Gene Name: solute carrier family 1 (neuronal/epithelial high affinity glutamate transporter, system Xag), member 1
  Uniprot ID: P43005
  ENST ID: ENST00000262352
  CDS Start-End: 237-1811
ggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttc

SEQ ID NO: 182754 - DNA, 726 bp, Homo sapiens
  Payload ID: 16010
  Gene Symbol: SLC1A1
  Gene Name: solute carrier family 1 (neuronal/epithelial high affinity glutamate transporter, system Xag), member 1
  ENST ID: ENST00000422398
  CDS Start-End: 1-726
tttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttcta

SEQ ID NO: 182755 - DNA, 1750 bp, Homo sapiens
  Payload ID: 16011
  Gene Symbol: SLC1A5
  Gene Name: solute carrier family 1 (neutral amino acid transporter), member 5
  Uniprot ID: Q15758
  ENST ID: ENST00000412532
  CDS Start-End: 223-1164
acgtggacaggacggggctttggggcccctggagcagagacttccctctagagtcttaggaaaactcgacaggatattgaggggaggctccagccctcgggagtaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagag

SEQ ID NO: 182756 - DNA, 1872 bp, Homo sapiens
  Payload ID: 16011
  Gene Symbol: SLC1A5
  Gene Name: solute carrier family 1 (neutral amino acid transporter), member 5
  Uniprot ID: Q15758
  ENST ID: ENST00000434726
  CDS Start-End: 228-1247
agcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactatgtactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactattt

SEQ ID NO: 182757 - DNA, 2882 bp, Homo sapiens
  Payload ID: 16011
  Gene Symbol: SLC1A5
  Gene Name: solute carrier family 1 (neutral amino acid transporter), member 5
  Uniprot ID: Q15758
  ENST ID: ENST00000542575
  CDS Start-End: 630-2255
agagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 182758 - DNA, 774 bp, Homo sapiens
  Payload ID: 16011
  Gene Symbol: SLC1A5
  Gene Name: solute carrier family 1 (neutral amino acid transporter), member 5
  ENST ID: ENST00000593713
  CDS Start-End: 1-774
gcacgccagcctcttggggctgaaggaggctgactccccaagtcctgcaaaggggtgcaagcctagttccaaccctgccgggctgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcct

SEQ ID NO: 182759 - DNA, 2031 bp, Homo sapiens
  Payload ID: 16011
  Gene Symbol: SLC1A5
  Gene Name: solute carrier family 1 (neutral amino acid transporter), member 5
  ENST ID: ENST00000594991
  CDS Start-End: 309-1406
aagctgtccagggtattaagtttgctgcatggggtggagctgaggcccggggcgacctgccctggcctgccgtgggaggccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactatggtatctaataaccctctgtgtgtctgtctctgcagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactattt

SEQ ID NO: 182760 - DNA, 276 bp, Homo sapiens
  Payload ID: 16011
  Gene Symbol: SLC1A5
  Gene Name: solute carrier family 1 (neutral amino acid transporter), member 5
  ENST ID: ENST00000598022
  CDS Start-End: 190-276
acaatgcctcagggctagcacgccagcctcttggggctgaaggaggctgactccccaagtcctgcaaagggaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgc

SEQ ID NO: 182761 - DNA, 2049 bp, Homo sapiens
  Payload ID: 16012
  Gene Symbol: SLC10A1
  Gene Name: solute carrier family 10 (sodium/bile acid cotransporter), member 1
  Uniprot ID: Q14973
  ENST ID: ENST00000216540
  CDS Start-End: 135-1184
ttctatttgcccagagcttttgtccagaaactctctgtcctgagaggtgattaaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctaaaaagttcagatcctattccttcccttttgacattattgggatgatgctcccgaaaagtcaaatttgacatcaagtatgcaaaagtgaacacagtaagatgcaatcaggcaaaacaaactcaaaaaatagctaatgaaatgaaaaaactgggcgaatgcatcatgttagtagaggaggaaaacttttgacaaggaaaaaccaggaaacaaacacatacattaacacaatgttacctcactaataatctcttttttaagttcagtaggtatttggttttaacacaaggcgcccccaaaactgggtacagcaaactactgccaaaatgagtcgtttcccaattcaaagaaaaatgttcaaatacctagaattcacaaatttcaaattgtctctaataaaatttaaacattttgcatatc

SEQ ID NO: 182762 - DNA, 3779 bp, Homo sapiens
  Payload ID: 16013
  Gene Symbol: SLC10A2
  Gene Name: solute carrier family 10 (sodium/bile acid cotransporter), member 2
  Uniprot ID: Q12908
  ENST ID: ENST00000245312
  CDS Start-End: 598-1644
ttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactattcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggtttctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatctttaacaccaaaactgaattcttatgcagaatttcctagcccatagatgacaacctgactttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttctgtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgttttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgtaa

SEQ ID NO: 182763 - DNA, 1502 bp, Homo sapiens
  Payload ID: 16014
  Gene Symbol: SLC10A6
  Gene Name: solute carrier family 10 (sodium/bile acid cotransporter), member 6
  Uniprot ID: Q3KNW5
  ENST ID: ENST00000273905
  CDS Start-End: 149-1282
ttaggatgaatcaccttgctggccaacagttattggaatgattctccatgtgtgacttcgttgcactattacaaaatgtggcaggatagacctgcccagccattgttgccgatgttcatttgtaatgctgccttaaggagatgaggagatgagagccaattgttccagcagctcagcctgccctgccaacagttcagaggaggagctgccagtgggactggaggtgcatggaaacctggagctcgttttcacagtggtgtccactgtgatgatggggctgctcatgttctctttgggatgttccgtggagatccggaagctgtggtcgcacatcaggagaccctggggcattgctgtgggactgctctgccagtttgggctcatgccttttacagcttatctcctggccattagcttttctctgaagccagtccaagctattgctgttctcatcatgggctgctgcccggggggcaccatctctaacattttcaccttctgggttgatggagatatggatctcagcatcagtatgacaacctgttccaccgtggccgccctgggaatgatgccactctgcatttatctctacacctggtcctggagtcttcagcagaatctcaccattccttatcagaacataggaattacccttgtgtgcctgaccattcctgtggcctttggtgtctatgtgaattacagatggccaaaacaatccaaaatcattctcaagattggggccgttgttggtggggtcctccttctggtggtcgcagttgctggtgtggtcctggcgaaaggatcttggaattcagacatcacccttctgaccatcagtttcatctttcctttgattggccatgtcacgggttttctgctggcactttttacccaccagtcttggcaaaggtgcaggacaatttccttagaaactggagctcagaatattcagatgtgcatcaccatgctccagttatctttcactgctgagcacttggtccagatgttgagtttcccactggcctatggactcttccagctgatagatggatttcttattgttgcagcatatcagacgtacaagaggagattgaagaacaaacatggaaaaaagaactcaggttgcacagaagtctgccatacgaggaaatcgacttcttccagagagaccaatgccttcttggaggtgaatgaagaaggtgccatcactcctgggccaccagggccaatggattgccacagggctctcgagccagttggccacatcacttcatgtgaatagcagggactagctggctggactggcccccttctttttcagtggccagtaaagacagtgtgcagctgacacatgaatcttgttggtagggccagtgtgaatatttaagtgttcaatgttagaatatttatattttcatgtggattgtgaattgtgatgggatcacttttggagattcccatttcagggagtttcttctgggggttaacataacgtatcaatg

SEQ ID NO: 182764 - DNA, 2161 bp, Homo sapiens
  Payload ID: 16015
  Gene Symbol: SLC10A3
  Gene Name: solute carrier family 10, member 3
  Uniprot ID: P09131
  ENST ID: ENST00000263512
  CDS Start-End: 527-1960
gaggggcttcggtggggcggggccctgacaggccgagctcgcgggcgactgccggccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaagcttg

SEQ ID NO: 182765 - DNA, 1763 bp, Homo sapiens
  Payload ID: 16015
  Gene Symbol: SLC10A3
  Gene Name: solute carrier family 10, member 3
  Uniprot ID: P09131
  ENST ID: ENST00000369649
  CDS Start-End: 216-1562
gctgcgcggtggctgtggcaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaagcttg

SEQ ID NO: 182766 - DNA, 1893 bp, Homo sapiens
  Payload ID: 16015
  Gene Symbol: SLC10A3
  Gene Name: solute carrier family 10, member 3
  ENST ID: ENST00000393586
  CDS Start-End: 99-1697
gacgctgcagctaagctgcgcggtggctgtggcagctcctgtactttgcctctcccaccccactggttttcctgcctccctcttcagaggtaagacacatggctggaccaaggcctccaggggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaa

SEQ ID NO: 182767 - DNA, 1862 bp, Homo sapiens
  Payload ID: 16015
  Gene Symbol: SLC10A3
  Gene Name: solute carrier family 10, member 3
  Uniprot ID: P09131
  ENST ID: ENST00000393587
  CDS Start-End: 265-1698
acaggccgagctcgcgggcgactgccggccaggcagacgctgcagctaagctgcgcggtggctgtggcaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgccc

SEQ ID NO: 182768 - DNA, 1167 bp, Homo sapiens
  Payload ID: 16015
  Gene Symbol: SLC10A3
  Gene Name: solute carrier family 10, member 3
  ENST ID: ENST00000453912
  CDS Start-End: 514-1167
ggggcggggccctgacaggccgagctcgcgggcgactgccggccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaagggg

SEQ ID NO: 182769 - DNA, 1790 bp, Homo sapiens
  Payload ID: 16016
  Gene Symbol: SLC10A4
  Gene Name: solute carrier family 10, member 4
  Uniprot ID: Q96EP9
  ENST ID: ENST00000273861
  CDS Start-End: 220-1533
acccggggggccgcgctgcgcggagtgccaggctgcgggcggctgcagacctgggagcggagaccggcccgccgcccccgacgccgccgagcacgtcagcggcgcgcagccggggctcggagaccgacgggcagaacgacgggcggcgactgcggcgaccgcgggacggcgagaggcacgcggcgggaggggaccggaatccgcagctccggccgcgccatggacggcaacgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtttccctgtggtctctgctagtgactctggtggtccttttcataatgaccggcactatgttaggacctgaactgctggcaagtatccctgcagctgtttatgtgatagcaatttttatgcctttggcaggctacgcttcaggttatggtttagctactctcttccatcttccacccaactgcaagaggactgtatgtctggaaacaggtagtcagaatgtgcagctctgtacagccattctaaaactggcctttccaccgcaattcataggaagcatgtacatgtttcctttgctgtatgcacttttccagtctgcagaagcggggatttttgttttaatctataaaatgtatggaagtgaaatgttgcacaagcgagatcctctagatgaagatgaagatacagatatttcttataaaaaactaaaagaagaggaaatggcagacacttcctatggcacagtgaaagcagaaaatataataatgatggaaaccgctcagacttctctctaaatgtggagatacacaggagcttctatcttgctgaaatattgcttcatatttatagcctgtggtagtgcacatggttaacataaaagataacactggttcacatcatacatgtaacaattctgatctttttaaggttcactggtgtattaaccaaacgttgtcacaaattacaaatcaatgctgtaatataatttgcacctggaatggctaacgtgaagcctgaattaaatgtggtttttagtttttaccatcaccaa

SEQ ID NO: 182770 - DNA, 2568 bp, Homo sapiens
  Payload ID: 16017
  Gene Symbol: SLC10A5
  Gene Name: solute carrier family 10, member 5
  Uniprot ID: Q5PT55
  ENST ID: ENST00000518568
  CDS Start-End: 1203-2519
ccttgaacacattgcatcatgattacatgaaagagctgctgaaatggtcatgtgttcagagactactacatctgtaggcttaatagtaaacgtttggttggttggttggtcggctggttggtttgctgcttagcatcaggacacccaccccttgtgtgggaaatatacaagtgtgtgagtctatgggttgaaatccaaaaagcctgatgctttttctcattcctggcaaccaagggatatgaccaaattgggtcaattgaatgcccttgcccctaactgtgaacagagagtagtgttacaaacaaggaataaaagattagaatcaatgccagtgtctttccattgccccatcgtgtcagggtccaagtgtccagtagctgtggtcccttaaccagcctgtacctttggccgtggcaccagctacctactttccctatgtccccaagttatctggtaaccattcaggaattttttttcctacttaggtatacaaaaaacagtgtcagtttttgcttgacagattaaatcatccttcagagatgcaggaaaactattagcagccaagggatgctgccaaggccagtgtctgggctctgcagttttctaacttgtgatattgggtcaccccactaagctccaggagagcagcgactgcatctggcttaatcattatgggatggccagctcccaattccatgccctaggcaaagagacattcagtgaatattgatttgacttcgacttgattgaacaaaatggtaacactgaactctaggtttcctcagtgtctgttacagatttcttgatcctgactgcttttaatttttttttttttagcaagaaataactaacgaatgatgacactaagctttaaattcaagtaaataggaggcttttttttttcgcataagcagaaatgaggaaatcaagaggaagagattagatttctgttgtgataaatcgaatctgttaaatgccatgactttttaattgtcttaatcacaagttaaaccggttgtgttgctgcttagatggctatatatttgtttaaaagtacagcagtccctcctactggactttgatcctacaaaaacaactgttatctaactcaccctcagactgtcactggaacacctgcatgaagaatgttctttcattttttaaaaacgattttgcatatatgatttatttcagctttcaaaatgattagaaaactttttattgttctacttttgttgcttgtgactatagaagaagcaaggatgtcatcgctcagttttctgaatatagagaagactgaaatactatttttcacaaagactgaagaaaccatccttgtaagttcaagctacgaaaataaacggcctaattccagccacctctttgtgaaaatagaagatcctaaaatactacaaatggtgaatgtggccaagaagatctcatcagatgctacaaactttaccataaatctggtgactgatgaagaaggagaaacaaatgtgactattcaactctgggattctgaaggtaggcaagaaagactcattgaagaaatcaagaatgtgaaagtcaaagtgctcaaacaaaaagacagtctactccaggcaccaatgcatattgatagaaatatcctaatgcttattttaccactaatactattgaataagtgtgcatttggttgtaagattgaattacagctgtttcaaacagtatggaagagacctttgccagtaattcttggggcagttacacagttttttctgatgccattttgcgggtttcttttgtctcagattgtggcattgcctgaggcgcaagcttttggagttgtaatgacctgcacgtgcccaggagggggtgggggctatctctttgctctgcttctagatggagatttcacattggccattttgatgacttgcacatcaacattattggctctgatcatgatgcctgtcaattcttatatatacagtaggatattagggttgtcaggtacattccatattcctgtttctaaaattgtgtcaacactccttttcatacttgtgccagtatcaattggaatagtcatcaagcatagaatacctgaaaaagcaagcttcttagagagaataattagacctctgagttttattttaatgttcgtaggaatttatttgactttcacagtgggattagtgttcttaaaaacagataatctagaggtgattctgttgggtctcttagttcctgctttgggtttgctgtttgggtactcctttgctaaagtttgtacgctgcctcttcctgtttgtaaaactgttgctattgaaagtgggatgttaaatagtttcttagctcttgccgttattcagctgtcttttccacagtccaaggccaatttagcttctgtggctccttttacagtagccatgtgttctggatgtgaaatgttactgatcattctagtttacaaggctaagaaaagatgtatctttttcttacaagataaaaggaaaagaaatttcctaatctaacaattaaagcattactgaattcctactctgggtagggcactgtgggaga

SEQ ID NO: 182771 - DNA, 2798 bp, Homo sapiens
  Payload ID: 16018
  Gene Symbol: SLC10A7
  Gene Name: solute carrier family 10, member 7
  Uniprot ID: Q0GE19
  ENST ID: ENST00000335472
  CDS Start-End: 217-1239
gagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataacaaaggaggtggactttctgtagcaatgtatatatgtacaggattgtacatactagcaattctgaagacttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtgcaatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatcaactcagcaggggtcatagatcgaatagatgctgaaaagcgtaagatatatgcattccttgacatcatttttaaagacattccttcaaatagtttccacacagaaattcctcactcccattatgagagattgtggttatatgtcttaaatttattataagctgcttcaaagaaagggtctgaatgtttgaattatgagtgaaatcatgtgaaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaaggtatttgagacaatttattaatgaaaatttccttggcagatttgacaaatgttggcaatatttttttagaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagtta

SEQ ID NO: 182772 - DNA, 1730 bp, Homo sapiens
  Payload ID: 16018
  Gene Symbol: SLC10A7
  Gene Name: solute carrier family 10, member 7
  Uniprot ID: Q0GE19
  ENST ID: ENST00000394059
  CDS Start-End: 179-658
tcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttggtaagtaaacatagtttaacttgtctattacaacttttgctgtgatattgtgtatatgaaagatttagtgaaagctggatttgttttactctttggttaagtataaaaattgttgaatcttttcatgtgccagtatccataccctgaagaaaagtagttaatgaataaagcaaatgttctcttacaatatattttggaggtttgggttttaaaattccatttaatgaattcaaggaatcaattaaaacactatgtgtctccttatagaggttatgtcaatatattgatcatttaatgaggtcttttagattattattattttgtatcatgggactgaggattttgaaaaggaaacatgacccagctggtcagaaagggaatgctaatttacttgttgacatgccatttattttgtacatttcactgtcaaagaagctactggcttggatgcttctgagaaatctatgtgaaaaaaaatttgaaaggaagatatgactaatgagtaatttgcaagtaaatgttgtatctatatatatatatatataaagattcaaaagtagttcagctttcataagtagaaccaatataaggacgttgttttagcatttttaatcattatttttaaataaatgatgtaacagaggcttgatttgtgttatgaaagattgagaaactaaattttctgttgatttaatttttttgtgccttaaaactttgttaaattcctgaagttaattatcatattgtattttttggggcataactcattagcagatatgtagtgcagtgatttacaaataattgagagtaaaatcagtgatgtataaactagttcatgagtctaggtaaaatatcaattacctctgtttaaaatgctctgttaattattattgtatgtatttaaatgtagttaaagcttttaaacatgttgttacatagtgttaattctacatagtgctacacagcttttagtgtcacatagccttacagagtttataatgatgtagcatctgcaaaatatatgcatagcttatatcctatttttatagagccagtaatggtttttgtgatgctgtattacttctgggttttagacaataaagtctgtttaacaaaa

SEQ ID NO: 182773 - DNA, 3747 bp, Homo sapiens
  Payload ID: 16018
  Gene Symbol: SLC10A7
  Gene Name: solute carrier family 10, member 7
  Uniprot ID: Q0GE19
  ENST ID: ENST00000432059
  CDS Start-End: 248-1231
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgagggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataacaaaggaggtggactttctgtagcaatgtatatatgtacaggattgtacatactagcaattctgaagacttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtgcaatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatcaactcagcaggggtcatagatcgaatagatgctgaaaagcgtaagatatatgcattccttgacatcatttttaaagacattccttcaaatagtttccacacagaaattcctcactcccattatgagagattgtggttatatgtcttaaatttattataagctgcttcaaagaaagggtctgaatgtttgaattatgagtgaaatcatgtgaaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaaggtatttgagacaatttattaatgaaaatttccttggcagatttgacaaatgttggcaatatttttttagaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagttattctcagtgtgaattttaaggctaatgccagatcctgcaaaaatctatgctaaccaggctgtagtacacactgttataaagaattttacttgtgtctaaaactacagtaattttgcttaggtaattgtgcttacctatggagcacaggaaggctcttaggttttgttcctacaagtttctttgaattttggagtaaatggaagtgtctgtctgtctgtcatctatctgccctatcataaaaatctttctccctaacattaaaatactgatccccgcccccaacttatctacctctattgtctaacacctatagtaggtgtgatcatgggataaaattcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatattttgttatgtttatacactgtaaagctatctgttttatgcatttgttttgtctaaatgtatttatgaaagaaatacattagattatatttatgtttactcatttttccacctggattttttttaatggttgttacaaaattagattttttaatgggtaataatgttggtattttcatgttttttcttagtattaaaatttttgtgggttttttaaaatttttccctattctgttaaaaattaacacacctctagctaatgttcagtgtttgtgctaaataccaaattttttcaaaaggattggttaagtcataaagtggattatttatgatgactggaagatgaaaataattatatgattaaacaaagaatgtttcagaaatcacaagagaaa

SEQ ID NO: 182774 - DNA, 1134 bp, Homo sapiens
  Payload ID: 16018
  Gene Symbol: SLC10A7
  Gene Name: solute carrier family 10, member 7
  Uniprot ID: Q0GE19
  ENST ID: ENST00000507030
  CDS Start-End: 1-1077
atgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagaaactactccaaaccagggggccactggctaacttgaataatccagaaggcttggaatatctatccatcaaatttgggcattaaaataaataccaagagtccatcctccagggagtgaagctgacaaggccgacagtataa

SEQ ID NO: 182775 - DNA, 869 bp, Homo sapiens
  Payload ID: 16018
  Gene Symbol: SLC10A7
  Gene Name: solute carrier family 10, member 7
  Uniprot ID: Q0GE19
  ENST ID: ENST00000511374
  CDS Start-End: 114-371
tgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagagtttgcagacagtaggttgcatgcctccgcctgtgtcttctgcagtgattttaaccaaggcagttggtggaaatgaggcagctgcaatatttaattcagcctttggaagttttttggtaagtaaacatagtttaacttgtctattacaacttttgctgtgatattgtgtatatgaaagatttagtgaaagctggatttgttttactctttggttaagtataaaaattgttgaatcttttcatgtgccagtatccataccctgaagaaaagtagttaatgaataaagcaaatgttctcttacaatatattttggaggtttgggttttaaaattccatttaatgaattcaaggaatcaattaaaacactatgtgtctccttatagaggttatgtcaatatattgatcatttaatgaggtcttttagattattattattttgtatcatgggactgaggattttgaaaaggaaacatgacccagctggtcagaaagggaatgctaatttacttgttgacatgccatttattttgtacatttcactgtcaaagaagctactggcttggatgcttctgag

SEQ ID NO: 182776 - DNA, 1638 bp, Homo sapiens
  Payload ID: 16018
  Gene Symbol: SLC10A7
  Gene Name: solute carrier family 10, member 7
  Uniprot ID: Q0GE19
  ENST ID: ENST00000502607
  CDS Start-End: 206-400
gtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagagcttcttacttaatgcgattctgcgaagcagccaactttgtgggatgcaggagttgaagaaggaagaatgccacagctgtcagcatttctctaaggactgacttcttttgtaagcacctaagaaaccttcagagtcatccagctaatttggatctaatgaaatgccgtgatctcgtgctttatcgtggtatctaagcagcaatcaaagccatttcttccatcaaaagcccttttcaaaagaatacaacattaagtcattttcaaaagccatataacttaagatgtcctagattgtatcattgtgtaatattaaaccacttctaaagcctgctaatttcatggttaacttgtaacttaggaggtagcagtcatatttgtttactagttagtaatcctaaattcatttcagtggggattacgatttatatgtcttattaggtcctaaaatagttcatttttgcatacaagagacagtgaattattattgacttgagtttatttggaagcatttgtgttggtcccattcaagtttgatttatattgaacatttcttatatgactcatacattgatttaatgacatgtattctaaaatttgttttagtaatttgttaaaattataaaggacactgtgctaatgcaatgctgagtcttcagttttatgacaacttctagttttttgaaattttgttgtattgaagtgaaatatggttacatttaaaattcatatttagttcacttcaaacctgtagtttcagaggctttgtcacttagccgactgtggcagggcgaatttgtttaaacaagtatcaattaagtgcttatggccacaaggcacggtgctggggatagaaacaaaggtgagcaggagacttaggggctgagaaaaggtcctgagtagggcagaagatgcaggcttttatttttctgtaaaaattattatcttttatcctattagcagaaaagcaaatatagcaaactctaaactttagatgtgtgctgtttgtttcaagcccagagctatgagcctgactctcagcaaatgaatgagatggtcagataaagggttacaagagaaatcggtgtctaatgaaaatatttctacgtcccaattagagccctggttttaagcaatgcttgatgctgtcaatgagactctggtataatcagtaaatgatgtggagtgtcttcttaagtttattttaatggattttgaccttattacatatgaataaacaaactatgatgcaga

SEQ ID NO: 182777 - DNA, 3852 bp, Homo sapiens
  Payload ID: 16019
  Gene Symbol: SLC11A1
  Gene Name: solute carrier family 11 (proton-coupled divalent metal ion transporter), member 1
  Uniprot ID: P49279
  ENST ID: ENST00000233202
  CDS Start-End: 341-1993
acagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaagga

SEQ ID NO: 182778 - DNA, 2136 bp, Homo sapiens
  Payload ID: 16019
  Gene Symbol: SLC11A1
  Gene Name: solute carrier family 11 (proton-coupled divalent metal ion transporter), member 1
  ENST ID: ENST00000354352
  CDS Start-End: 122-613
gatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaagtcggagtctcgctccgtcgcccagtcaggagtgcaatggtgcgatgtcagctcactgcaacctctacctcccaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaa

SEQ ID NO: 182779 - DNA, 1765 bp, Homo sapiens
  Payload ID: 16019
  Gene Symbol: SLC11A1
  Gene Name: solute carrier family 11 (proton-coupled divalent metal ion transporter), member 1
  ENST ID: ENST00000539932
  CDS Start-End: 167-415
gatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacagggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggaggctggagtgcaatggcgcgatctccggctcaccgcaacctccacctcctgggttcaagcaattctcctgcctcagcctcctgaccagctgggattacaggccaccacacccagctaattttgtattttcagtaaagacggggtttctccatgttggtcagggtggtctcgaactcccagcctcaggtgatctgccctcctcagcctcccaaagtgctgggattacaggcgtgagccaccgcgcccggctctttctttcttttttgagacaggatttcactctgttgctcaggctggagtgcaatggcgccatcacagctcgctgcagcctcaacttcagcctcccgagtcattgggactacaggctcatgccaccacaccaggctaatttttaaaattatttgtagagatgtggtcttcctatgtttcccaggctggtctcgaactcctgggctcaagtgatcttcccgccttggcttcccaaagtgctgggattacagacgtgagccaccccactcagctttgtttccttcatgtagcccagagggcgacactataagccccattttacagatgaga

SEQ ID NO: 182780 - DNA, 421 bp, Homo sapiens
  Payload ID: 16019
  Gene Symbol: SLC11A1
  Gene Name: solute carrier family 11 (proton-coupled divalent metal ion transporter), member 1
  ENST ID: ENST00000481524
  CDS Start-End: 97-222
acacttacttgcaccagtgcccagagagggggtgcaggctgaggagctgcccagagcaccgctcacactcccagagtacctgaagtcggcatttcaatgacagcttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagct

SEQ ID NO: 182781 - DNA, 624 bp, Homo sapiens
  Payload ID: 16019
  Gene Symbol: SLC11A1
  Gene Name: solute carrier family 11 (proton-coupled divalent metal ion transporter), member 1
  ENST ID: ENST00000473367
  CDS Start-End: 201-473
aacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaagtcggagtctcgctccgtcgcccagtcaggagtgcaatggtgcgatgtcagctcactgcaacctctacctcccaggtgccccgcaccgtcctctggctgaccatcgag

SEQ ID NO: 182782 - DNA, 3986 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000262051
  CDS Start-End: 89-1795
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccacactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggtgggaatgcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccagacattgcctatgttcgtttataatcggcccttaaagaggcagggatttttctaaaatgacactttaaaatttcctcatttctacttcagggcctcttgaaacttcagataatgagagcagccaaccctgcaactcaggctatagagtccttctgatcttaaaactgagactgaattcacatcagttttacgcttttacttgaaaaagagactcttaagtgtttttggtttctttatacaggacaacaa

SEQ ID NO: 182783 - DNA, 4132 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000262052
  CDS Start-End: 114-1799
agcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 182784 - DNA, 4156 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000394904
  CDS Start-End: 51-1823
atatatagaggcaggagctggcattgggaaagtcaaactagttctgcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 182785 - DNA, 1937 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000545993
  CDS Start-End: 112-1785
agagtacaaagggttcctgcttggtggttttgctgcagcttcagagtttagcctgaactgtggcaggattttgtaacttgcacattttttgagaagtctgatggaggtataatgtccacggtcgattatttgaacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttg

SEQ ID NO: 182786 - DNA, 2470 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000541174
  CDS Start-End: 406-2091
agagtccaggactgatggagtcgcgccattcagagaaagacccaaagatgggggcagggagggaacgccggaggtcgcgggggtctcgccccttccccgccgcggcctaggacacatggcccagctcccagctgcaccggatggcgcgcccggcctgtgtcggggtgcgctgacctgcttcgacgcctcgaaagaggccgacgggcacagggcaaggtctttcgtggcctcttcgtcggcgccgcagggggccgggctgctctccggggcctcccgccgccccgcttcaacaaaagactcattataacctaaccgacttcagggagcgccttctgtgtgaatagcctgcatacgcggctcagtaattaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaac

SEQ ID NO: 182787 - DNA, 924 bp, Homo sapiens
  Payload ID: 16020
  Gene Symbol: SLC11A2
  Gene Name: solute carrier family 11 (proton-coupled divalent metal ion transporter), member 2
  ENST ID: ENST00000547510
  CDS Start-End: 123-344
gcgttagccagcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagaataagaggctgatggaacctgcagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatc

SEQ ID NO: 182788 - DNA, 2486 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000547198
  CDS Start-End: 63-1769
gcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggca

SEQ ID NO: 182789 - DNA, 1740 bp, Homo sapiens
  Payload ID: 16020
  Gene Symbol: SLC11A2
  Gene Name: solute carrier family 11 (proton-coupled divalent metal ion transporter), member 2
  ENST ID: ENST00000546743
  CDS Start-End: 287-1735
ggggagggcgttagccagcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactg

SEQ ID NO: 182790 - DNA, 587 bp, Homo sapiens
  Payload ID: 16020
  Gene Symbol: SLC11A2
  Gene Name: solute carrier family 11 (proton-coupled divalent metal ion transporter), member 2
  ENST ID: ENST00000550714
  CDS Start-End: 145-587
agcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttgtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgt

SEQ ID NO: 182791 - DNA, 546 bp, Homo sapiens
  Payload ID: 16020
  Gene Symbol: SLC11A2
  Gene Name: solute carrier family 11 (proton-coupled divalent metal ion transporter), member 2
  ENST ID: ENST00000547732
  CDS Start-End: 253-546
atatggagccctgggcgcgggggcggcgtgtcaggtggttgcggagctgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgta

SEQ ID NO: 182792 - DNA, 565 bp, Homo sapiens
  Payload ID: 16020
  Gene Symbol: SLC11A2
  Gene Name: solute carrier family 11 (proton-coupled divalent metal ion transporter), member 2
  ENST ID: ENST00000549110
  CDS Start-End: 304-565
gagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaatactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattg

SEQ ID NO: 182793 - DNA, 581 bp, Homo sapiens
  Payload ID: 16020
  Gene Symbol: SLC11A2
  Gene Name: solute carrier family 11 (proton-coupled divalent metal ion transporter), member 2
  ENST ID: ENST00000547579
  CDS Start-End: 132-581
gttagccagcgtggcgctggctcccggaatatggagccctgggcgcgggggcggcgtgtcaggtggttgcggagctgtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtg

SEQ ID NO: 182794 - DNA, 530 bp, Homo sapiens
  Payload ID: 16020
  Gene Symbol: SLC11A2
  Gene Name: solute carrier family 11 (proton-coupled divalent metal ion transporter), member 2
  ENST ID: ENST00000548150
  CDS Start-End: 522-530
ggcagcacttcttgttaaggaatggggaagcttcttatgaatctaatcttactctaatgttaggaaatcagcagtggtcccttggattactctacaaagctagtaggcagctttggttcagttatgactcagtgaaggttagagaattatatctacaaagtaggatctttttctttctttctttcgttttttgatacggagtttcgctcttgttgcccaggctggaatgtaatagcgcgatctcggctcactgcaacctctgcctcccgggttcaagcgattctcctgcctcagcctcttgatgcctggcgaattttttttgtatttttagtagtgacggggtttcaccatgttggccaggctggtctggaactcctgacctcaagtgatccacctgtatcggccttccgaagtgctggggtggtgtgagccaccgcgccctgccagatctttcttgtttgactttcattgctaagaatttggaatcatattctaagaactcagccactcaggtatccaccatggtgctg

SEQ ID NO: 182795 - DNA, 585 bp, Homo sapiens
  Payload ID: 16020
  Gene Symbol: SLC11A2
  Gene Name: solute carrier family 11 (proton-coupled divalent metal ion transporter), member 2
  ENST ID: ENST00000549625
  CDS Start-End: 109-351
agcgtggcgctggctcccggaatatggagccctgggcgcgggggcggcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggaggctagagtgcaatggtgcaatcctggctcaccgcaacctcctcctcccgcattcaagtgattctcctgcctcagcctcccgagtagctgggattacagaataagaggctgatggaacctgcaggtaagggaagagctttgacttggacagagaagtggccagcttcttaataaaaatactcttgttttagctttcgtaaactctgggctttcaccggaccaggttttcttatgagcattgcctacctggatccaggaaatattgaatccgatttgcagtctggagcagtggctg

SEQ ID NO: 182796 - DNA, 2125 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000546636
  CDS Start-End: 93-1799
ccggaatatggagccctgggcgcgggggcggcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaa

SEQ ID NO: 182797 - DNA, 2401 bp, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENST ID: ENST00000547688
  CDS Start-End: 243-2015
ccctttcaaccactggcactcacaggcttgccacctactcttgctcctgccaaatggtcaaagatgaaatctgattaggctttggagggcgtggtttgcctcttgaaattccttgctcgtctttagaaagctgtgttgcttagagcacccaaaagtgccctttatctaactgagggaggcgcacttgtcttcatatatagaggcaggagctggcattgggaaagtcaaactagttctgcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaa

SEQ ID NO: 182798 - DNA, 576 bp, Homo sapiens
  Payload ID: 16020
  Gene Symbol: SLC11A2
  Gene Name: solute carrier family 11 (proton-coupled divalent metal ion transporter), member 2
  ENST ID: ENST00000548193
  CDS Start-End: 130-576
agcgtggcgctggctcccggaatatggagccctgggcgcgggggcggcgtgtcaggtggttgcggagctggtaaggtgaggggaaggcaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctg

SEQ ID NO: 182799 - DNA, 609 bp, Homo sapiens
  Payload ID: 16020
  Gene Symbol: SLC11A2
  Gene Name: solute carrier family 11 (proton-coupled divalent metal ion transporter), member 2
  ENST ID: ENST00000551215
  CDS Start-End: 1-380
atgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggacaacaactctagatgaaaccagtgtgttggattttccccgcctccctgggtggttttatttctcagttgtttcattaccagagagtgttggggaaacgaaggtaaaaaataaaaacatcctgttgtgaaactcatagaaa

SEQ ID NO: 182800 - DNA, 569 bp, Homo sapiens
  Payload ID: 16020
  Gene Symbol: SLC11A2
  Gene Name: solute carrier family 11 (proton-coupled divalent metal ion transporter), member 2
  ENST ID: ENST00000546488
  CDS Start-End: 109-569
agcgtggcgctggctcccggaatatggagccctgggcgcgggggcggcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggt

SEQ ID NO: 182801 - DNA, 4765 bp, Homo sapiens
  Payload ID: 16021
  Gene Symbol: SLC12A4
  Gene Name: solute carrier family 12 (potassium/chloride transporter), member 4
  Uniprot ID: Q9UP95
  ENST ID: ENST00000316341
  CDS Start-End: 142-3399
cccggggggcgggcggaggaagtgagcgcagcggggaggaatgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 182802 - DNA, 4670 bp, Homo sapiens
  Payload ID: 16021
  Gene Symbol: SLC12A4
  Gene Name: solute carrier family 12 (potassium/chloride transporter), member 4
  Uniprot ID: Q9UP95
  ENST ID: ENST00000422611
  CDS Start-End: 41-3304
cccggggggcgggcggaggaagtgagcgcagcggggaggaatgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 182803 - DNA, 3627 bp, Homo sapiens
  Payload ID: 16021
  Gene Symbol: SLC12A4
  Gene Name: solute carrier family 12 (potassium/chloride transporter), member 4
  Uniprot ID: Q9UP95
  ENST ID: ENST00000541864
  CDS Start-End: 105-3269
gagtcctgctagatccccgcaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacg

SEQ ID NO: 182804 - DNA, 3525 bp, Homo sapiens
  Payload ID: 16021
  Gene Symbol: SLC12A4
  Gene Name: solute carrier family 12 (potassium/chloride transporter), member 4
  Uniprot ID: Q9UP95
  ENST ID: ENST00000537830
  CDS Start-End: 39-3278
agtgcatggtggggtagccagccggccacctttgggccatggcagccgaaggtgctgtgtgcggcttcgtctatctggagggcactgcctgggcggtccctgaggacaccgaacccttggcatcctgcacattgggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcct

SEQ ID NO: 182805 - DNA, 3768 bp, Homo sapiens
  Payload ID: 16021
  Gene Symbol: SLC12A4
  Gene Name: solute carrier family 12 (potassium/chloride transporter), member 4
  Uniprot ID: Q9UP95
  ENST ID: ENST00000576616
  CDS Start-End: 1-3207
atgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactgtatccctttgtggagaggcaggcagttgggaggtggatagcatgggaggtcaagccagcggcttctctcctgggcacccctgggtgggcatggcccaggtggcccgggttgcccgttgattctgttgttgcctccttgacttgaggccctgcagacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagag

SEQ ID NO: 182806 - DNA, 868 bp, Homo sapiens
  Payload ID: 16021
  Gene Symbol: SLC12A4
  Gene Name: solute carrier family 12 (potassium/chloride transporter), member 4
  ENST ID: ENST00000576377
  CDS Start-End: 64-228
gacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggacc

SEQ ID NO: 182807 - DNA, 3620 bp, Homo sapiens
  Payload ID: 16021
  Gene Symbol: SLC12A4
  Gene Name: solute carrier family 12 (potassium/chloride transporter), member 4
  ENST ID: ENST00000572037
  CDS Start-End: 81-3194
acggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactat

SEQ ID NO: 182808 - DNA, 406 bp, Homo sapiens
  Payload ID: 16021
  Gene Symbol: SLC12A4
  Gene Name: solute carrier family 12 (potassium/chloride transporter), member 4
  ENST ID: ENST00000570616
  CDS Start-End: 1-59
cccctgacaatttccgggagctggtgcacattaagccgatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctg

SEQ ID NO: 182809 - DNA, 891 bp, Homo sapiens
  Payload ID: 16021
  Gene Symbol: SLC12A4
  Gene Name: solute carrier family 12 (potassium/chloride transporter), member 4
  ENST ID: ENST00000571299
  CDS Start-End: 358-891
gtcttgcggggcccagcggctctgattccgtaccccccaccccaagggctggaggctggcagtaggcgtagtcagaggacgccacccgagccacgcgagggagaagagtggagatagacaagacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggc

SEQ ID NO: 182810 - DNA, 588 bp, Homo sapiens
  Payload ID: 16021
  Gene Symbol: SLC12A4
  Gene Name: solute carrier family 12 (potassium/chloride transporter), member 4
  ENST ID: ENST00000575857
  CDS Start-End: 1-271
gccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctg

SEQ ID NO: 182811 - DNA, 6061 bp, Homo sapiens
  Payload ID: 16022
  Gene Symbol: SLC12A5
  Gene Name: solute carrier family 12 (potassium/chloride transporter), member 5
  Uniprot ID: Q9H2X9
  ENST ID: ENST00000243964
  CDS Start-End: 164-3514
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattatacccttca

SEQ ID NO: 182812 - DNA, 3593 bp, Homo sapiens
  Payload ID: 16022
  Gene Symbol: SLC12A5
  Gene Name: solute carrier family 12 (potassium/chloride transporter), member 5
  Uniprot ID: Q9H2X9
  ENST ID: ENST00000454036
  CDS Start-End: 77-3496
ctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccc

SEQ ID NO: 182813 - DNA, 1105 bp, Homo sapiens
  Payload ID: 16022
  Gene Symbol: SLC12A5
  Gene Name: solute carrier family 12 (potassium/chloride transporter), member 5
  ENST ID: ENST00000539566
  CDS Start-End: 122-682
tcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggacc

SEQ ID NO: 182814 - DNA, 571 bp, Homo sapiens
  Payload ID: 16022
  Gene Symbol: SLC12A5
  Gene Name: solute carrier family 12 (potassium/chloride transporter), member 5
  ENST ID: ENST00000608944
  CDS Start-End: 202-571
agtttttgtgcaagggggccactagtcgggctctgcccgcccctcatcttctcttctctctccctcccgctctccccccaaaaccccgccagtggctcacgcctcctgcatacgggatgaggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatga

SEQ ID NO: 182815 - DNA, 6166 bp, Homo sapiens
  Payload ID: 16022
  Gene Symbol: SLC12A5
  Gene Name: solute carrier family 12 (potassium/chloride transporter), member 5
  ENST ID: ENST00000616933
  CDS Start-End: 164-952
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctgagtctcactctgttgcccaggctggagggcagtggtgcagtcactgacagcctcgacttcccaggttcaaatgatcccccccaccagttcagcctcccaagtagctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 182816 - DNA, 2445 bp, Homo sapiens
  Payload ID: 16022
  Gene Symbol: SLC12A5
  Gene Name: solute carrier family 12 (potassium/chloride transporter), member 5
  ENST ID: ENST00000616202
  CDS Start-End: 164-1033
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctgagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 182817 - DNA, 2955 bp, Homo sapiens
  Payload ID: 16022
  Gene Symbol: SLC12A5
  Gene Name: solute carrier family 12 (potassium/chloride transporter), member 5
  ENST ID: ENST00000616201
  CDS Start-End: 164-1543
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccatatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 182818 - DNA, 1224 bp, Homo sapiens
  Payload ID: 16022
  Gene Symbol: SLC12A5
  Gene Name: solute carrier family 12 (potassium/chloride transporter), member 5
  ENST ID: ENST00000626937
  CDS Start-End: 164-706
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 182819 - DNA, 401 bp, Homo sapiens
  Payload ID: 16022
  Gene Symbol: SLC12A5
  Gene Name: solute carrier family 12 (potassium/chloride transporter), member 5
  ENST ID: ENST00000628272
  CDS Start-End: 68-229
agagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaa

SEQ ID NO: 182820 - DNA, 411 bp, Homo sapiens
  Payload ID: 16022
  Gene Symbol: SLC12A5
  Gene Name: solute carrier family 12 (potassium/chloride transporter), member 5
  ENST ID: ENST00000413737
  CDS Start-End: 1-203
ggcattcggtcgcagacccccgccacctcccgggggaagacgtcaaagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaagtctgtca

SEQ ID NO: 182821 - DNA, 617 bp, Homo sapiens
  Payload ID: 16022
  Gene Symbol: SLC12A5
  Gene Name: solute carrier family 12 (potassium/chloride transporter), member 5
  ENST ID: ENST00000626701
  CDS Start-End: 55-417
agccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaa

SEQ ID NO: 182822 - DNA, 583 bp, Homo sapiens
  Payload ID: 16022
  Gene Symbol: SLC12A5
  Gene Name: solute carrier family 12 (potassium/chloride transporter), member 5
  ENST ID: ENST00000627290
  CDS Start-End: 162-338
gtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgagcctcctagcactgacaccctccctccataggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatgga

SEQ ID NO: 182823 - DNA, 7286 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000290209
  CDS Start-End: 102-3401
ggatcacagtctgaaacgacagcaaggaagaggtaggcagggaaaactaactggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatgaaccagacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctccccccgcccccacccccgcgcctttttttatgccctcttattaagcacaggtcaaaaaatcttaaggaacaaatactaggaaaactggctaaacatccttccctgaaagcactggaccatcttttaaagggcacatctagcaatggaattggaagttctagagccacactctttctttagtgccaacgttactgagcggctactctccttacctactttactaaaatggcatacagattggcattgacctgttgaagaaattttaccactaagaaatcttttgcctcatctacaaagccatagttaagacttgaggcattcaacttaatgccaagtataagcatttccccctttttctttcaattttattcttcattctgactacagaaacttggccctgaactacgagattagccaagccaacagtcttctaatttgttttcagaaacttcaggccgggtgccgtggctcacacctgtaatcccagcactttgggaggccaaggcaggtgaatcacttgaggtcaggagttcgagaccatcctggccaacatggtgaaaacctgtctatactaaaaatacaaaaattagctgggcatggtggtgcatgcctgtgatcccagcaacacggaaggctaaggcaggaggatcatttgaacccaggaggcggaggttgcagtgagccaggattgcacctctgcactccagcctgggtaacagagtgatatgtttcaaaaagaaagttcagtgtgccaaggaaatacttgtgtaagctcagctttttatttactaatatactgatcaaacatctggcttacaagcatagggaaactacttatgtggctggctgagcagtaatttcaagtatgtgaaatcttcatttcttttacagaatagttatttagagaaacttttcttgcctgtattcatggctgtttttgaatttcaatttattagtcataaatagtgccactcttctttgattactaaataggacatggagcaagctgacctaggtgtcacaaattattcatttgacctgtaaggacagagaaaacccttcaatatagcttaagaaattgagtaattttgggccgggtgcagtgactcacgcctgtaatcccagcactttgggaggccgaggcaggcggatcacgaggtcaggagatttgagaccatcctggctaacacggtgaaaccctgtctctacaaaaatacaaaaaaattagtcgggcatggtggcgggcgcctgtagtcccagctacttgggaggctgaggcgggagaatggcgtgaacccgggaggtggaacttgcagtgaaccgagattgcaccactgcactccagcctgggcgacagagggagactccatctcaaaaaaaaaaaaaaagaaagaaagaaagaaattgagtaattttgatttgttccctttgcttgcttcaacctccaggcccactgaggatggcaaagcggataggatcttaagtctttttttctgttacttcctacagatggtagaagcattatttacaactcccactgcaacactccattgcttagttgagtttaacagtagtgagtcatgtcctgcaggatccagtatcttttttttttttttccgagacgtagtttcgctcttgttgcccaggctggagtgaaatggcacaatcttggctcaccgcaacctctgcctcctgggttcaagcgattctcctgcctcagcctcccgagtagctggaattacaagcatgtgccaccacacccagctaattttgtattttcagtagagacggggtttctctactgaaactgatgttggtcaggctggtctcgaactcccaacctcaggtgatccgcccgccttggcctcccaaagtgctgggattacaggcgtgagccactgtgcccaaccaggatccagtatcttaaaggcccatactgtaaaggtcagcctgcctaggaattctgccacatttacacacacccctggccaaagtaatattttttttttccatgtagaacaaattatgggcagaaagtaaagttagttttagaagtgctgtttgtggttggagaattgtaaaaatcttttaaagggataagggaattagtggcttttaatataaccactgcttcagcccgaaacacaaaatcactgttacatggaaaactggttattaggccagatttatattcatgtctgtctagagtatttcatgtgtgtatgtgttgcttacgttgtctgtctccaaagtctctcatctcttttaatcactgcaaataaagcaatactgaaaacttgagagaatgcaccttaggggaaggggctatttcaagacagaaaacaaaggaaatacctgccttttgaataagatcccgcttttgagtcttacctatgactttaccagggtagattagaaatacacatcctcctgctgaccctctgccttcaatagctatctatcttaaaagctgaagtttgaactgcagcatctgcttgacaggtgccaggttccttcggcagggggacgatcactctatatatcttccgttgcctcagattcctgtggcccaaggatcccaccaatcctcgttccccctaaacatgctaacaaaaatcccttatcgtgggtattaaaataataacagttacactgtatgcatatttatgtgctccttttgtctggtttttcttttcatcatgtataagctgaattcagcattagtttctcacatcttcccccaggtatccccaacagaatttttatgtcccagcttgtattaaatagaagtgaaatattaaggaaaataaggaacttgtgcaactttttttatgcattgttctcaaccatttaatttattgaaaggagatgctgcaacagttcttgatttagcagcagttattctcttgtttacatagttatgtttttttgttgttgttttgctctgtactggaaacaaaaataaagttttctacattattttca

SEQ ID NO: 182824 - DNA, 4568 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000354181
  CDS Start-End: 494-3946
gcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagttcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182825 - DNA, 4096 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000397702
  CDS Start-End: 199-3474
tgcactcggtcaccgcgggctgcggcggctgggcggggctttcgggcgcccgcgggacggttccgccctctcactgcacccccgggcttctcttcgcaaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182826 - DNA, 4194 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000397707
  CDS Start-End: 165-3572
tgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182827 - DNA, 4425 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000458406
  CDS Start-End: 528-3803
agctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182828 - DNA, 3744 bp, Homo sapiens
  Payload ID: 16023
  Gene Symbol: SLC12A6
  Gene Name: solute carrier family 12 (potassium/chloride transporter), member 6
  ENST ID: ENST00000560164
  CDS Start-End: 237-3125
agttacctagcaaacaatcttcatgttaagactgagctcaaataccacttcttccttaatggtccctgtgatcactccaggaaatgtaatacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatcc

SEQ ID NO: 182829 - DNA, 567 bp, Homo sapiens
  Payload ID: 16023
  Gene Symbol: SLC12A6
  Gene Name: solute carrier family 12 (potassium/chloride transporter), member 6
  ENST ID: ENST00000561120
  CDS Start-End: 112-567
actcggtcaccgcgggctgcggcggctgggcggggctttcgggcgcccgcgggacggttccgccctctcactgcacccccgggcttctcttcgcaagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaa

SEQ ID NO: 182830 - DNA, 3866 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000558589
  CDS Start-End: 441-3866
tgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataa

SEQ ID NO: 182831 - DNA, 576 bp, Homo sapiens
  Payload ID: 16023
  Gene Symbol: SLC12A6
  Gene Name: solute carrier family 12 (potassium/chloride transporter), member 6
  ENST ID: ENST00000559236
  CDS Start-End: 170-576
actcggtcaccgcgggctgcggcggctgggcggggctttcgggcgcccgcgggacggttccgccctctcactgcacccccgggcttctcttcgcaagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctt

SEQ ID NO: 182832 - DNA, 548 bp, Homo sapiens
  Payload ID: 16023
  Gene Symbol: SLC12A6
  Gene Name: solute carrier family 12 (potassium/chloride transporter), member 6
  ENST ID: ENST00000559484
  CDS Start-End: 367-548
atcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattc

SEQ ID NO: 182833 - DNA, 4454 bp, Homo sapiens
  Payload ID: 16023
  Gene Symbol: SLC12A6
  Gene Name: solute carrier family 12 (potassium/chloride transporter), member 6
  ENST ID: ENST00000559523
  CDS Start-End: 528-3356
agctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatggtgagaaagctgagtttgagatacaagagcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182834 - DNA, 3725 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000558667
  CDS Start-End: 104-3556
actcggtcaccgcgggctgcggcggctgggcggggctttcgggcgcccgcgggacggttccgccctctcactgcacccccgggcttctcttcgcaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctccca

SEQ ID NO: 182835 - DNA, 5111 bp, Homo sapiens
  Payload ID: 16023
  Gene Symbol: SLC12A6
  Gene Name: solute carrier family 12 (potassium/chloride transporter), member 6
  ENST ID: ENST00000559664
  CDS Start-End: 1107-3827
gaaacagttaccggctagtaaacaacagctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtgggttatttttcccgttatgcatgtgcacctttcccaccagacccaagtggattgtcgacatcaaaaacaccgggtggctttgcatacacctccccccagccagacctgtggggtattcacctgatacacaacaggtggccgggtgtacaccttttagcaatctgatccacgctatagtcgcctgataaaggtttgcctgcacgcacttcgcccaactagaaccgtgggacactcaccagataaaggactacctcgacaggaaactgggggctgaggggagggaggcttcatctgctgccctgagaccatggcactgagccttcagccccggaccagaggggttagctaggtagctcttcattctgaaggaaagaagtcacacaagattggcattgttttgtctttttgttttttgtttttttctctcttaaaaaatatattcacctattggtgatgcactttctaggacagtcggcttgaattctgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattgcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182836 - DNA, 490 bp, Homo sapiens
  Payload ID: 16023
  Gene Symbol: SLC12A6
  Gene Name: solute carrier family 12 (potassium/chloride transporter), member 6
  ENST ID: ENST00000560332
  CDS Start-End: 170-490
atgttaagactgagctcaaataccacttcttccttaatggtccctgtgatcactccaggaaatgtaatacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtg

SEQ ID NO: 182837 - DNA, 5407 bp, Homo sapiens
  Payload ID: 16023
  Gene Symbol: SLC12A6
  Gene Name: solute carrier family 12 (potassium/chloride transporter), member 6
  ENST ID: ENST00000561080
  CDS Start-End: 1378-4098
actcggtcaccgcgggctgcggcggctgggcggggctttcgggcgcccgcgggacggttccgccctctcactgcacccccgggcttctcttcgcaaggttcacctcgaatgaggaacaagcggggagggaagggaagggctgcggcggcgcgggcgcaccccgtcgggcccggggctgggggaggccaggtcacgtaactgctgctctggcgtcgggccggggagggggcgccagccccggcagcgcgaaccctgcgcgcgccgcggctctgaaacagttaccggctagtaaacaacagctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtgggttatttttcccgttatgcatgtgcacctttcccaccagacccaagtggattgtcgacatcaaaaacaccgggtggctttgcatacacctccccccagccagacctgtggggtattcacctgatacacaacaggtggccgggtgtacaccttttagcaatctgatccacgctatagtcgcctgataaaggtttgcctgcacgcacttcgcccaactagaaccgtgggacactcaccagataaaggactacctcgacaggaaactgggggctgaggggagggaggcttcatctgctgccctgagaccatggcactgagccttcagccccggaccagaggggttagctaggtagctcttcattctgaaggaaagaagtcacacaagattggcattgttttgtctttttgttttttgtttttttctctcttaaaaaatatattcacctattggtgatgcactttctaggacagtcggcttgaattctgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattgcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatggtgagaaagctgagtttgagatacaagagcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatc

SEQ ID NO: 182838 - DNA, 4239 bp, Homo sapiens
  Payload ID: 16023
  Gene Symbol: SLC12A6
  Gene Name: solute carrier family 12 (potassium/chloride transporter), member 6
  Uniprot ID: Q9UHW9
  ENST ID: ENST00000560611
  CDS Start-End: 165-3617
tgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccggacctcagctctcgatctagttcccgagtaagatttagctcccgggaaagcgtgcctgaaacaagccggagtgagcctatgagtgagatgtctggggccaccacttcgctggcaactgttgcactggatccacccagtgaccggacttctcacccccaggatgtcatcgaggacctgagtcagaactccatcacaggggaacacagccaactgttagacgacggacataagaaagctcgaaatgcttatctcaataattccaattatgaagaaggagatgaatattttgataaaaatttggcactctttgaggaagaaatggacaccagaccgaaggtgtcttccctcctcaaccgcatggccaattacactaatctgactcaaggagcaaaggaacatgaagaggcagaaaacatcactgaagggaaaaagaagcccaccaagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtacaatgttgactgctatctccatgagtgccattgccactaatggagtggtgccagctgggggctcatactttatgatttcccgggcactgggcccagagtttggtggggctgttggcctctgcttttatcttggtaccacatttgcagcagccatgtacatccttggtgccattgaaatctttctggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtatcatggctggatcaaacagatctggagatctgaaagatgctcagaagtctattccgattggtactatccttgccatcctgaccacctcctttgtttatttaagcaatgttgtcctttttggtgcatgtattgaaggggttgttctcagagacaagttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtttttggccacagcaaagccaatggggaacctacctgggctttacttctaactgctgccattgcagagcttggaatactcattgcctccctggatcttgtggccccaattctttccatgttttttctcatgtgttacctctttgtaaacttggcatgtgccttgcaaacattacttcgaacacccaactggagaccccgattccgctactaccattgggccctttctttcatgggaatgagtatctgtctggctctgatgttcatttcttcctggtattatgccattgtagccatggtaatagctggtatgatctacaagtacattgaataccaaggagctgagaaagaatggggtgatggtatccgtgggctgtccctcagtgcagcccggtttgctttgcttcgattggaggaaggacctccacacactaaaaactggaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgctccggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccggaccagtccaatgtgaggcggatgcatacagcagtgaaactcaacgaggttatagttaacaagtcccatgaagcaaagctggttttattgaatatgccagggccaccccgaaaccctgagggtgatgaaaactacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaa

SEQ ID NO: 182839 - DNA, 5280 bp, Homo sapiens
  Payload ID: 16024
  Gene Symbol: SLC12A7
  Gene Name: solute carrier family 12 (potassium/chloride transporter), member 7
  Uniprot ID: Q9Y666
  ENST ID: ENST00000264930
  CDS Start-End: 45-3296
agcgcgggccgggccgggacggggactgtcggctgcaggcggccatgcccaccaacttcaccgtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcgcactgccctacgtgctcaccgacatcgcggcctccttcaccctgctggttggcatctacttcccttccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagagcctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtggacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatctggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccgcccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctgagtacgttg

SEQ ID NO: 182840 - DNA, 1066 bp, Homo sapiens
  Payload ID: 16024
  Gene Symbol: SLC12A7
  Gene Name: solute carrier family 12 (potassium/chloride transporter), member 7
  ENST ID: ENST00000513223
  CDS Start-End: 1-1066
ggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtggacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaa

SEQ ID NO: 182841 - DNA, 5280 bp, Homo sapiens
  Payload ID: 16024
  Gene Symbol: SLC12A7
  Gene Name: solute carrier family 12 (potassium/chloride transporter), member 7
  ENST ID: ENST00000611005
  CDS Start-End: 45-3296
agcgcgggccgggccgggacggggactgtcggctgcaggcggccatgcccaccaacttcaccgtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcacactgccctacgtgctcaccgacatcgcggcctccttcaccctgctggttggcatctacttcccttccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagagcctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtggacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtatcacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccgcccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccgcctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcgccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctgagtacgttg

SEQ ID NO: 182842 - DNA, 1041 bp, Homo sapiens
  Payload ID: 16024
  Gene Symbol: SLC12A7
  Gene Name: solute carrier family 12 (potassium/chloride transporter), member 7
  ENST ID: ENST00000628680
  CDS Start-End: 1-1041
ggtacgcggctggacaaaccccgacttcctttcccacagggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtggacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtatcacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaa

SEQ ID NO: 182843 - DNA, 680 bp, Homo sapiens
  Payload ID: 16024
  Gene Symbol: SLC12A7
  Gene Name: solute carrier family 12 (potassium/chloride transporter), member 7
  ENST ID: ENST00000504576
  CDS Start-End: 1-192
cccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggtgaggccactcagcacgggcgtgaggagccccacaggctgggacactgggtgcctctgccactggtgaggccgctcagcacaggcgtcaggagccccacaggctgggacactgggtgcctctacaaggccagctgctctgggcctgaagaccccagcgcgtccttgactgttcctttgcggagtaagcccctgcgcagctgatgagactgcacctgaggaaggcctctggttacgaggatgcccaggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgc

SEQ ID NO: 182844 - DNA, 3142 bp, Homo sapiens
  Payload ID: 16024
  Gene Symbol: SLC12A7
  Gene Name: solute carrier family 12 (potassium/chloride transporter), member 7
  ENST ID: ENST00000634447
  CDS Start-End: 1-2968
ggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcgcactgccctacgtgctcaccgacatcgcggcctccttcaccctgctggttggcatctacttcccttccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagagcctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtggacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatctggtttcaaagacctcttcagcatgaagccagaatggggaaacctggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccgcccaagctgcccatggggcttcctacggaagtttctaggcccgtcacctagggctctcc

SEQ ID NO: 182845 - DNA, 4208 bp, Homo sapiens
  Payload ID: 16025
  Gene Symbol: SLC12A3
  Gene Name: solute carrier family 12 (sodium/chloride transporter), member 3
  ENST ID: ENST00000262502
  CDS Start-End: 26-3088
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggc

SEQ ID NO: 182846 - DNA, 5567 bp, Homo sapiens
  Payload ID: 16025
  Gene Symbol: SLC12A3
  Gene Name: solute carrier family 12 (sodium/chloride transporter), member 3
  Uniprot ID: P55017
  ENST ID: ENST00000438926
  CDS Start-End: 30-3122
ctggcccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggcatggccacctttctgttgtgccttgcatttgtccacacacagggagtctggctgagctggggaaaggccacggctgggtgtcattgccattttcccagctcatctcaccgggaagaaaagcagattgacagaacacgtgaggaggggtattgatggcaggagagtcaaaaaagagttttaaagaaggggcaaggttgaaggagtctagtggcaagggtaagatttcaggcatggttaagaacagacgacaaggatgtcaggaatgaagatgtggagaggggtgtagagatggcaaggttggcaaggaacagataggcaggagcaggtccaagccaagcctagcccaagaccaggtgaaaggagaggggaggaggagccacctgcaagagatggaaagagcaggcggcagagggggctggcagggaggggctgttaagagtggggttggaggtgggagagaagctaggacaagggagatggagaaaggacctatacctggctcacggaaggccttcaggtcactacacgttgaacatccccagtgtttgagcccccaaagctagggtgcaagagcactgccatcgaatgccagtgggtgaggccaagtgagggtatttgcagctctagacataaccaagaagcgtaaaggtgagttgtttggtggtacgactgcctgtgccttcttccgatggcactggggtggctgaaggaacagacatctttgggtttcatcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattcagtcaacggaa

SEQ ID NO: 182847 - DNA, 4208 bp, Homo sapiens
  Payload ID: 16025
  Gene Symbol: SLC12A3
  Gene Name: solute carrier family 12 (sodium/chloride transporter), member 3
  Uniprot ID: P55017
  ENST ID: ENST00000563236
  CDS Start-End: 26-3091
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaa

SEQ ID NO: 182848 - DNA, 3119 bp, Homo sapiens
  Payload ID: 16025
  Gene Symbol: SLC12A3
  Gene Name: solute carrier family 12 (sodium/chloride transporter), member 3
  Uniprot ID: P55017
  ENST ID: ENST00000566786
  CDS Start-End: 30-3119
ctggcccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaa

SEQ ID NO: 182849 - DNA, 1764 bp, Homo sapiens
  Payload ID: 16026
  Gene Symbol: SLC12A1
  Gene Name: solute carrier family 12 (sodium/potassium/chloride transporter), member 1
  ENST ID: ENST00000330289
  CDS Start-End: 187-1479
ctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggcactgaggaaacaaggagcttcacctctccctcaaggagctcagagtcgaaggaggagacagacttcccttatatgaattagaacaagcaagagtagaatcaagtgcaaaggaaagaggaagcagaaattgcctgtcccctcaaaaagtaaaggaagactttcagaagaggggacactcaatccaggttttgagggatgaacaggagtttgccgacaggacaaagaagagacggacatttgaaacagaaggaatgggatgtaagaaggcaccaagaaagatgctgctaatgagaattattttaagtgcagagtagtgtatgtaatccttcattaatatattaataaacatatttataaataa

SEQ ID NO: 182850 - DNA, 4707 bp, Homo sapiens
  Payload ID: 16026
  Gene Symbol: SLC12A1
  Gene Name: solute carrier family 12 (sodium/potassium/chloride transporter), member 1
  Uniprot ID: Q13621
  ENST ID: ENST00000380993
  CDS Start-End: 217-3516
tacatttcctcagaagaaggctccttggtgctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagaggatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatgaaaaccaccaatgtgattgtaaacttctccagacaaacttaaccttttgtttcttaattttttgttttgagtgtttgcttctcagccctggtataggtctcagccccacagcaggatctcaataaatgcttattgacaggctggcatagtaaccacaggtggttatcaaaggaaaagaccaataggctggggaacataattatgcttggccccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgattttctgatgaatggcttgatttttctccttgacatgttttgactgttcattctaactgaaaacatatatgggaaaatatgaacctgaaataaaagcactcaaattc

SEQ ID NO: 182851 - DNA, 4708 bp, Homo sapiens
  Payload ID: 16026
  Gene Symbol: SLC12A1
  Gene Name: solute carrier family 12 (sodium/potassium/chloride transporter), member 1
  Uniprot ID: Q13621
  ENST ID: ENST00000396577
  CDS Start-End: 216-3515
acatttcctcagaagaaggctccttggtgctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagtcatcatcattggcctaagtgtggtagtaacgacactcacaggtatttctatgtctgctatttgcacgaatggagtagtaagaggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagaggatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatgaaaaccaccaatgtgattgtaaacttctccagacaaacttaaccttttgtttcttaattttttgttttgagtgtttgcttctcagccctggtataggtctcagccccacagcaggatctcaataaatgcttattgacaggctggcatagtaaccacaggtggttatcaaaggaaaagaccaataggctggggaacataattatgcttggccccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgattttctgatgaatggcttgatttttctccttgacatgttttgactgttcattctaactgaaaacatatatgggaaaatatgaacctgaaataaaagcactcaaattcaa

SEQ ID NO: 182852 - DNA, 2176 bp, Homo sapiens
  Payload ID: 16026
  Gene Symbol: SLC12A1
  Gene Name: solute carrier family 12 (sodium/potassium/chloride transporter), member 1
  ENST ID: ENST00000559641
  CDS Start-End: 231-2176
gttactgaaccgatcagcgaacacagacaaacgtgccaacacttaagtctactggctggacttcatctccatggcaacaagcatggaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaaca

SEQ ID NO: 182853 - DNA, 3426 bp, Homo sapiens
  Payload ID: 16026
  Gene Symbol: SLC12A1
  Gene Name: solute carrier family 12 (sodium/potassium/chloride transporter), member 1
  Uniprot ID: Q13621
  ENST ID: ENST00000558405
  CDS Start-End: 15-3314
atcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgtaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagagga

SEQ ID NO: 182854 - DNA, 664 bp, Homo sapiens
  Payload ID: 16026
  Gene Symbol: SLC12A1
  Gene Name: solute carrier family 12 (sodium/potassium/chloride transporter), member 1
  ENST ID: ENST00000561127
  CDS Start-End: 324-664
tgtctcaccaacagacacagacatttacacttctaggccaggaaagcgctaaccagggccctgtgactctacgcaggttccagaacacgccttctacatttgttactgaaccgatcagcgaacacagacaaacgtgccaacacttaagtctactggctggacttcatctccatggcaacaagcatggaagaatgtggcagtcaccccaagttcagctgacagagttgctaacggtgatgggatacctggagatgaacaagctgaaaataaggaagatgatcaagctggtgttgtgaagtttggatgggtgaaaggtaagatgcatgctgaacatctggggagtcatgctcttcattcgcctctcctggattgttggagaagctggaattggtcttggagttctcataattcttctttccaccatggtaacttctattactgggttgtcaacttctgcgatagcaactaacgggtttgttcgtggaggtggggcctactatcttatttccagaagtttagggcccgagttcggtgggtcaataggcctgatctttgcttttgctaatgcagtggctgttgctatgtatgtggtgggatttgctgagactgtagtagatcttcttaaggagagtgattcgatgatggtggatccaaccaatgacat

SEQ ID NO: 182855 - DNA, 582 bp, Homo sapiens
  Payload ID: 16026
  Gene Symbol: SLC12A1
  Gene Name: solute carrier family 12 (sodium/potassium/chloride transporter), member 1
  ENST ID: ENST00000558805
  CDS Start-End: 1-311
aggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggtacgttgtttgctctgctttgcagtcctgggagtggtggtacacttggtgggtagcacaaggagctagagaggttagatgtgaccatattaccctacagattcaaactgtaggtttctgcaagatttcctgatgatttaaaagttctctcttttaatgccaaatttggatttatattccagataattcttccaaaagtcttattcagtgatatcagaagaacagggtagtgtgatagtgtgtcatatttccccaaaataaatgtagttcagtgaaaaaaataccagaaccaccctttctcttttaaacccaaatgaataggaatattttcctgtaaaag

SEQ ID NO: 182856 - DNA, 735 bp, Homo sapiens
  Payload ID: 16026
  Gene Symbol: SLC12A1
  Gene Name: solute carrier family 12 (sodium/potassium/chloride transporter), member 1
  ENST ID: ENST00000561031
  CDS Start-End: 1-654
atgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattgagtatccttcttggcatgattggtaaaacttcactgaacaaaaataacttgtgagaaaactggtgaaaatgtgacctgactaataaaaatgctgaattgttgaactt

SEQ ID NO: 182857 - DNA, 6885 bp, Homo sapiens
  Payload ID: 16027
  Gene Symbol: SLC12A2
  Gene Name: solute carrier family 12 (sodium/potassium/chloride transporter), member 2
  Uniprot ID: P55011
  ENST ID: ENST00000262461
  CDS Start-End: 190-3828
acactcgcgcgctcgctcggctgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtcca

SEQ ID NO: 182858 - DNA, 5509 bp, Homo sapiens
  Payload ID: 16027
  Gene Symbol: SLC12A2
  Gene Name: solute carrier family 12 (sodium/potassium/chloride transporter), member 2
  Uniprot ID: P55011
  ENST ID: ENST00000343225
  CDS Start-End: 108-3698
tctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgca

SEQ ID NO: 182859 - DNA, 4263 bp, Homo sapiens
  Payload ID: 16027
  Gene Symbol: SLC12A2
  Gene Name: solute carrier family 12 (sodium/potassium/chloride transporter), member 2
  ENST ID: ENST00000509205
  CDS Start-End: 165-3617
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagttttatgaaccatgctaaattcttatttccacatggtctaggaatgactgtcctgtttcatttcagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaa

SEQ ID NO: 182860 - DNA, 3617 bp, Homo sapiens
  Payload ID: 16027
  Gene Symbol: SLC12A2
  Gene Name: solute carrier family 12 (sodium/potassium/chloride transporter), member 2
  ENST ID: ENST00000628403
  CDS Start-End: 165-3617
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagttttatgaaccatgctaa

SEQ ID NO: 182861 - DNA, 3447 bp, Homo sapiens
  Payload ID: 16028
  Gene Symbol: SLC12A8
  Gene Name: solute carrier family 12, member 8
  Uniprot ID: A0AV02
  ENST ID: ENST00000393469
  CDS Start-End: 51-2195
tccagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcct

SEQ ID NO: 182862 - DNA, 2831 bp, Homo sapiens
  Payload ID: 16028
  Gene Symbol: SLC12A8
  Gene Name: solute carrier family 12, member 8
  Uniprot ID: A0AV02
  ENST ID: ENST00000430155
  CDS Start-End: 30-1577
agttgccaggggagattgaaaagcagcctatgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcctaa

SEQ ID NO: 182863 - DNA, 493 bp, Homo sapiens
  Payload ID: 16028
  Gene Symbol: SLC12A8
  Gene Name: solute carrier family 12, member 8
  ENST ID: ENST00000462437
  CDS Start-End: 156-493
cagggtaaagggtttcctgaagtttctacctgctctaagtttctacccttgaggctgattgactagtccagtgagatcaaggaaatgaaaggcatttcacacaccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccat

SEQ ID NO: 182864 - DNA, 2989 bp, Homo sapiens
  Payload ID: 16028
  Gene Symbol: SLC12A8
  Gene Name: solute carrier family 12, member 8
  Uniprot ID: A0AV02
  ENST ID: ENST00000469902
  CDS Start-End: 112-2256
agccacgtggcggcggggcggggaccgggcgggccgggcgctgggagctggctgtcccaggagcagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacaccc

SEQ ID NO: 182865 - DNA, 3045 bp, Homo sapiens
  Payload ID: 16028
  Gene Symbol: SLC12A8
  Gene Name: solute carrier family 12, member 8
  ENST ID: ENST00000473262
  CDS Start-End: 1-481
gcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctg

SEQ ID NO: 182866 - DNA, 622 bp, Homo sapiens
  Payload ID: 16028
  Gene Symbol: SLC12A8
  Gene Name: solute carrier family 12, member 8
  ENST ID: ENST00000479826
  CDS Start-End: 1-622
ctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgg

SEQ ID NO: 182867 - DNA, 3273 bp, Homo sapiens
  Payload ID: 16029
  Gene Symbol: SLC12A9
  Gene Name: solute carrier family 12, member 9
  Uniprot ID: Q9BXP2
  ENST ID: ENST00000354161
  CDS Start-End: 126-2870
gtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacac

SEQ ID NO: 182868 - DNA, 720 bp, Homo sapiens
  Payload ID: 16029
  Gene Symbol: SLC12A9
  Gene Name: solute carrier family 12, member 9
  ENST ID: ENST00000448342
  CDS Start-End: 156-293
ggctccaggcctggcatcccggtagccgcagctgtcttttccggcccccgtgcactctccgcccgagcggagccccccggctcgcggggatcgcccccgagcgctgcgtcctgcgggtggctggctatgctgaggactacaccacgggagccgtgatgaattttgccagcgtctttgctgtcctctttaacggctgtacaggcatcatggctggggccaacatgtcaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagggttcactggcactttctggggctcattgacactttggggtacactggcattctttggtgttcactggcattttgggggtgcactggcactttggaacaacggcacgcctcttggcccttgcccagctggtgctcctggctgggaagctgaacacactggctgctgtggtcactgtcttctacctggtggcctatgctgccgtggacctgtcctgcctgagcctggagtgggcctcggcccccaacttccg

SEQ ID NO: 182869 - DNA, 916 bp, Homo sapiens
  Payload ID: 16029
  Gene Symbol: SLC12A9
  Gene Name: solute carrier family 12, member 9
  ENST ID: ENST00000418037
  CDS Start-End: 448-916
gcatcccggtagccgcagctgtcttttccggcccccgtgcactctccgcccgagcggagccccccggctcgcggggatcgcccccgagcgctgcgtcctgcggatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtgg

SEQ ID NO: 182870 - DNA, 589 bp, Homo sapiens
  Payload ID: 16029
  Gene Symbol: SLC12A9
  Gene Name: solute carrier family 12, member 9
  ENST ID: ENST00000434158
  CDS Start-End: 204-589
ttcctcttgcattgctagttaaggaaggagaggctggagaagcctgtgccgtcagagaacctttgcccctttccagaaccggtgccatccctagtctcaggaacataagggaaggggtggcccccaggagccgggaggggccttgaaacccctgctgacaggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgt

SEQ ID NO: 182871 - DNA, 840 bp, Homo sapiens
  Payload ID: 16029
  Gene Symbol: SLC12A9
  Gene Name: solute carrier family 12, member 9
  ENST ID: ENST00000416675
  CDS Start-End: 106-840
tccgcccgagcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctg

SEQ ID NO: 182872 - DNA, 1912 bp, Homo sapiens
  Payload ID: 16029
  Gene Symbol: SLC12A9
  Gene Name: solute carrier family 12, member 9
  Uniprot ID: Q9BXP2
  ENST ID: ENST00000415287
  CDS Start-End: 146-1762
cccggtagccgcagctgtcttttccggcccccgtgcactctccgcccgagcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtcaaactcgcatcccctgccgtgaaacagatgccccgctagaagccgggagtggacagcatcctcctctccatagaattggagtgctcattagtggcaagaatcctaaggcgaactttgcctgtttaagtggaggagattagtcactgagataataaaataaatgcatgtgaaa

SEQ ID NO: 182873 - DNA, 2269 bp, Homo sapiens
  Payload ID: 16029
  Gene Symbol: SLC12A9
  Gene Name: solute carrier family 12, member 9
  Uniprot ID: Q9BXP2
  ENST ID: ENST00000540482
  CDS Start-End: 160-2055
aggctccaggcctggcatcccggtagccgcagctgtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtctgggacgctattaccctggggattcaggtcatgagcttggctgatcagggtgtctggtttgcacaacagagtcaaactcgcatcccctgccgtgaaacagatgccccgctagaagccgggagtggacagcatcctcctctccatagaattggagtgctcattagtggcaagaatcctaaggcgaactttgcctgtttaagtggaggagattagtcactgagataataaaataaatgcatgtgaaagtg

SEQ ID NO: 182874 - DNA, 3815 bp, Homo sapiens
  Payload ID: 16030
  Gene Symbol: SLC13A1
  Gene Name: solute carrier family 13 (sodium/sulfate symporter), member 1
  Uniprot ID: Q9BZW2
  ENST ID: ENST00000194130
  CDS Start-End: 41-1828
tttatttggaggacactattgaagccacctgctcaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaaaaagaaggaaaaaagaataagaatgaaaactgctgacgtattacaaaacagaaaaataaatgatttaaaatcaaatcaaaaagaaaaaactaaacatttaaacaaaaatgggataagaatagtcttctagaagtgaggatgcgaaaaagaatgagtttccaattaccctgatgtgacaattacacattgtagacaggtagcaaaatatcacatacacccccaaaatatgtacaaatattatatatcaataaataaatttttaaagagtaagtgctattggcattccaaaattcagctaaaggaaaaatgatcaaaaacaaagtaaggtgcacagttagcaaaagatgcagatgttatatcacagcaattctcatgctaaaaatacaacaaaagacaaagcaaaaaataaacctttgcttttttttttttttttttttttttgagacggagtctcgctctgtcgcccaggctggagtgcagtggcgggatctcggctcactgcaagctccgcctcccaggttcacgccattctcctgcctcagccaaacctttgctatttttaatcttcgttggcactttccagctgttactgaccttgtcattttttattcaaataagattatttacaaacttattcttgaaactaaatatagtaaagagggtttttaaaataatatttaacatacgaattattaattggccatgttcattatttatctatgtttattaatgggccaatgcaaaaaatcattttttcaaagaaaaatttgtccatgtaaagcttaaattataatattgctgctttgtataactcttctatgtttattctattcatttgttcctttccctaccatattttacacatgtatttataatctgtagtatttattacatttctgcttttttctagtcattcaatttatcactgctgaattgcatcagatcatggatgcatttttattatgaaaaaataaaatgacttttcaaattataa

SEQ ID NO: 182875 - DNA, 2861 bp, Homo sapiens
  Payload ID: 16030
  Gene Symbol: SLC13A1
  Gene Name: solute carrier family 13 (sodium/sulfate symporter), member 1
  ENST ID: ENST00000427975
  CDS Start-End: 27-137
actattgaagccacctgctcaggacaatgaaattcttcagttacattctggtttatcgccgatttctcttcgtggttttcactgtgttggttttactacctctgcccatcgtcctccacaccaagagtaagttgtaataacgatatcggatgtatcagcaacttccagcagacttgggggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaa

SEQ ID NO: 182876 - DNA, 2457 bp, Homo sapiens
  Payload ID: 16030
  Gene Symbol: SLC13A1
  Gene Name: solute carrier family 13 (sodium/sulfate symporter), member 1
  ENST ID: ENST00000439260
  CDS Start-End: 26-148
ctattgaagccacctgctcaggacaatgaaattcttcagttacattctggtttatcgccgatttctcttcgtggttttcactgtgttggttttactacctctgcccatcgtcctccacaccaagcttattctgacttttccaagatgaagatgaagagcaggccagtggcatgggccagatgcagtcagatgactgactgaccaggagggcctccgtccagtgaccagtctcagaatttaaaggacccttcccccttacttatgcttgtactcagcccaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagtacttgcaagtgaggtgaccaaaaaacagctttagactcttaaacttagtgtttaaaatgagaaggctgagagacagtctgcttatggagaaagttggagtatttccccagtgccccaaccccctgccacttgtaccatcacagtcgaaagaagggaagagtctcctacttaacaaggaagaggaagaatcaaaccaacaaagggtgtttacagggtcatgggtgagaaaaagaatgaagttgcttttggcttacaccctagaaagtcatctcttaaataaaacacttacatttggactagtgattccccaagtgaaaccatttcaggatgtgccattgtccaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacc

SEQ ID NO: 182877 - DNA, 2222 bp, Homo sapiens
  Payload ID: 16030
  Gene Symbol: SLC13A1
  Gene Name: solute carrier family 13 (sodium/sulfate symporter), member 1
  ENST ID: ENST00000539873
  CDS Start-End: 139-624
ccagcctcataatatcaccttttgctttgcatttgttcttaccaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagtacttgcaagtgaggtgaccaaaaaacagctttagactcttaaacttagtgtttaaaatgagaaggctgagagacagtctgcttatggagaaagttggagtatttccccagtgccccaaccccctgccacttgtaccatcacagtcgaaagaagggaagagtctcctacttaacaaggaagaggaagaatcaaaccaacaaagggtgtttacagggtcatgggtgagaaaaagaatgaagttgcttttggcttacaccctagaaagtcatctcttaaataaaacacttacatttggactagtgattccccaagtgaaaccatttcaggatgtgccattgtccaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacc

SEQ ID NO: 182878 - DNA, 2897 bp, Homo sapiens
  Payload ID: 16031
  Gene Symbol: SLC13A4
  Gene Name: solute carrier family 13 (sodium/sulfate symporter), member 4
  Uniprot ID: Q9UKG4
  ENST ID: ENST00000354042
  CDS Start-End: 691-2571
ctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctttacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggagccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagagtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctgtctgaaacgctgcacattaaccccctctacaccctgatcccagtcaccatgtgcatctcctttgcagtgatgctgcctgtgggcaatccccctaatgccatcgtcttcagctatgggcactgccagatcaaagatatggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaa

SEQ ID NO: 182879 - DNA, 578 bp, Homo sapiens
  Payload ID: 16031
  Gene Symbol: SLC13A4
  Gene Name: solute carrier family 13 (sodium/sulfate symporter), member 4
  ENST ID: ENST00000378428
  CDS Start-End: 241-578
atttccaagtagtatagttgcagatcttcgaacgccattcctgtgttctgtgaattcaagacaacatgggttttataaccctttgactctgctcagcatctcccagatcaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctttacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggt

SEQ ID NO: 182880 - DNA, 572 bp, Homo sapiens
  Payload ID: 16031
  Gene Symbol: SLC13A4
  Gene Name: solute carrier family 13 (sodium/sulfate symporter), member 4
  ENST ID: ENST00000422620
  CDS Start-End: 343-572
gtcacttccctggtcactttagcctggggatcatttccaagtagtatagttgcagatcttcgaacgccattcctgtgttctgtgaattcaagacaacatgggttttataaccctttgactctgctcagcatctcccagatcaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctttacccgttcttcggagtcctccggtccaatgaggt

SEQ ID NO: 182881 - DNA, 3176 bp, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENST ID: ENST00000293800
  CDS Start-End: 37-1692
ctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacgtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcg

SEQ ID NO: 182882 - DNA, 1738 bp, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENST ID: ENST00000381074
  CDS Start-End: 34-1611
actcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaa

SEQ ID NO: 182883 - DNA, 3435 bp, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENST ID: ENST00000433363
  CDS Start-End: 235-1941
agcgttggagtccaaagacgcctcccaccgccgccgggtggcagaattgggggcaggcgcgtcccacagaccccgaggggtggccccgccccagggccgcggggaggcgcccccgtgcggggcggagttgtcaccgccccctccccaatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctcca

SEQ ID NO: 182884 - DNA, 1723 bp, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENST ID: ENST00000573648
  CDS Start-End: 45-1613
agctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgat

SEQ ID NO: 182885 - DNA, 419 bp, Homo sapiens
  Payload ID: 16032
  Gene Symbol: SLC13A5
  Gene Name: solute carrier family 13 (sodium-dependent citrate transporter), member 5
  ENST ID: ENST00000570687
  CDS Start-End: 1-283
cccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtaacacagctgtttttatttactcccgtcggactataacgctgttgtcataagggatgccccatttatgaatgacagagtttcaaaacgatgtcatgtgacttgggaatgccacggaacatccagacctgtagccattgttgacatttataatgcagcttttcttctttttctg

SEQ ID NO: 182886 - DNA, 547 bp, Homo sapiens
  Payload ID: 16032
  Gene Symbol: SLC13A5
  Gene Name: solute carrier family 13 (sodium-dependent citrate transporter), member 5
  ENST ID: ENST00000575230
  CDS Start-End: 37-312
ctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcagggagacaccactcgagcctgcatccccactccaagctgtccctgaagtcagcatctggggactgggtggctctagtgtgtggcaagggacagtcctgatgaggccttcgtgccacgctccaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatggg

SEQ ID NO: 182887 - DNA, 986 bp, Homo sapiens
  Payload ID: 16032
  Gene Symbol: SLC13A5
  Gene Name: solute carrier family 13 (sodium-dependent citrate transporter), member 5
  ENST ID: ENST00000572094
  CDS Start-End: 27-272
tcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatct

SEQ ID NO: 182888 - DNA, 538 bp, Homo sapiens
  Payload ID: 16032
  Gene Symbol: SLC13A5
  Gene Name: solute carrier family 13 (sodium-dependent citrate transporter), member 5
  ENST ID: ENST00000572352
  CDS Start-End: 37-538
ctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgt

SEQ ID NO: 182889 - DNA, 2711 bp, Homo sapiens
  Payload ID: 16033
  Gene Symbol: SLC13A2
  Gene Name: solute carrier family 13 (sodium-dependent dicarboxylate transporter), member 2
  Uniprot ID: Q13183
  ENST ID: ENST00000314669
  CDS Start-End: 421-2199
ggagaacagcagaaaggaaaggccgggccagcggaggtggcttgggggctgcctgtggagggtggctgggggactctccttccttctccagctcctccagcaccaccctcagcagcctccaagaacagaaggagttaacgctgggattaacttcttgaaggaacctgaagttttttaatccttgttctttcctccttccttctccctctcccttcctgatctttactccgcctgtgggtccctcctccttactctcacctccccaactccaaaaacactctgattgccagactgggtcaatggttaacactcaactggctttatataagcctgccacctgcctgcttggctgcatctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagtaaa

SEQ ID NO: 182890 - DNA, 2855 bp, Homo sapiens
  Payload ID: 16033
  Gene Symbol: SLC13A2
  Gene Name: solute carrier family 13 (sodium-dependent dicarboxylate transporter), member 2
  Uniprot ID: Q13183
  ENST ID: ENST00000444914
  CDS Start-End: 421-2346
ggagaacagcagaaaggaaaggccgggccagcggaggtggcttgggggctgcctgtggagggtggctgggggactctccttccttctccagctcctccagcaccaccctcagcagcctccaagaacagaaggagttaacgctgggattaacttcttgaaggaacctgaagttttttaatccttgttctttcctccttccttctccctctcccttcctgatctttactccgcctgtgggtccctcctccttactctcacctccccaactccaaaaacactctgattgccagactgggtcaatggttaacactcaactggctttatataagcctgccacctgcctgcttggctgcatctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgagatcattcagagaccatttccatccagtttcgagagcccaggggaatgccagtctgtgggaatgtcagtgactgcatcccataacctcgggggcaccgtgggagactccagggtcttcccgccgctcagccatgtctccacctgccaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagt

SEQ ID NO: 182891 - DNA, 1276 bp, Homo sapiens
  Payload ID: 16033
  Gene Symbol: SLC13A2
  Gene Name: solute carrier family 13 (sodium-dependent dicarboxylate transporter), member 2
  ENST ID: ENST00000545060
  CDS Start-End: 200-1276
atctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggctttttttggctggggcaatttggcttttcccaatgccaagggggagaggtgagagttgcaggggttgggaggaggacacatctggggctcacatgctcgggaaggagggaagggtatagggcccccattgcagaacaggaggtaacacttggtgggggatga

SEQ ID NO: 182892 - DNA, 2320 bp, Homo sapiens
  Payload ID: 16033
  Gene Symbol: SLC13A2
  Gene Name: solute carrier family 13 (sodium-dependent dicarboxylate transporter), member 2
  ENST ID: ENST00000579281
  CDS Start-End: 1-83
gggcctatcgctcctacctgatcgtgttcttcgtgcccattctcctgctgcctctgcccatcctcgtccccagtaagctgtgaaatgtgaacaatagttattacctctgagagcaaataaatgcaacttgtaaaagcatttgaagcacatagaatatgacgcctggcacaaagtcatcctccaatacttatacagaaacttcttcctgaatcagcagagaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttg

SEQ ID NO: 182893 - DNA, 2217 bp, Homo sapiens
  Payload ID: 16033
  Gene Symbol: SLC13A2
  Gene Name: solute carrier family 13 (sodium-dependent dicarboxylate transporter), member 2
  ENST ID: ENST00000577903
  CDS Start-End: 22-129
cagcccttgctgctccacaccatggccacctgctggcaggccctgtgggcctatcgctcctacctgatcgtgttcttcgtgcccattctcctgctgcctctgcccatcctcgtccccagtaagctgtgaaatgtgaacaatagttattacctctgagagcaaataaatgcaacttgtaaaagcatttgaagcacatagaatatgacgcctggcacaaagtcatcctccaatacttatacagaaacttcttcctgaatcagcagagaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagaggtgagagttgcaggggttgggaggaggacacatctggggctcacatgctcgggaaggagggaagggtatagggcccccattgcagaacaggaggtaacacttggtgggggatgaaggttccccaggcttgtctatgggagaggctcatctccaccaccctccaccctgtggccctgagcaaccccaagcggctaacccagccctccccgcgccccctccaccaacagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccact

SEQ ID NO: 182894 - DNA, 2466 bp, Homo sapiens
  Payload ID: 16033
  Gene Symbol: SLC13A2
  Gene Name: solute carrier family 13 (sodium-dependent dicarboxylate transporter), member 2
  ENST ID: ENST00000459818
  CDS Start-End: 1-83
gggcctatcgctcctacctgatcgtgttcttcgtgcccattctcctgctgcctctgcccatcctcgtccccagtaagctgtgaaatgtgaacaatagttattacctctgagagcaaataaatgcaacttgtaaaagcatttgaagcacatagaatatgacgcctggcacaaagtcatcctccaatacttatacagaaacttcttcctgaatcagcagagaggcctactgcgcgtatgccatcatcctcatggcgctcttctggtgcactgaggccctgcccctggccgtcactgccctcttccccttaatcctgttccctatgatgggcatcgtggatgcctctgagatcattcagagaccatttccatccagtttcgagagcccaggggaatgccagtctgtgggaatgttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagt

SEQ ID NO: 182895 - DNA, 4017 bp, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENST ID: ENST00000279027
  CDS Start-End: 20-1828
ccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttatt

SEQ ID NO: 182896 - DNA, 3994 bp, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENST ID: ENST00000290317
  CDS Start-End: 128-1795
ggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaacctgt

SEQ ID NO: 182897 - DNA, 848 bp, Homo sapiens
  Payload ID: 16034
  Gene Symbol: SLC13A3
  Gene Name: solute carrier family 13 (sodium-dependent dicarboxylate transporter), member 3
  ENST ID: ENST00000372121
  CDS Start-End: 103-848
gagaagggtgtgtttgtttccccatctgccatgattataagttttctgaggcatccccagccatgctgaactgaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagcaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgtttt

SEQ ID NO: 182898 - DNA, 707 bp, Homo sapiens
  Payload ID: 16034
  Gene Symbol: SLC13A3
  Gene Name: solute carrier family 13 (sodium-dependent dicarboxylate transporter), member 3
  ENST ID: ENST00000450298
  CDS Start-End: 1-707
ctttcacaactttggcaatggctgctcagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaag

SEQ ID NO: 182899 - DNA, 1256 bp, Homo sapiens
  Payload ID: 16034
  Gene Symbol: SLC13A3
  Gene Name: solute carrier family 13 (sodium-dependent dicarboxylate transporter), member 3
  ENST ID: ENST00000420568
  CDS Start-End: 1-906
gaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagcaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctggatgcaaaatgggcattataagcatttcaacaatacagaaaatgtgaagatcagctaaatctcagtctctaattctgatatacatctttcctgacttttaaacaatgcctatctgagaactgttctacattgtgatcacgctgttatcggactgcatacatttgtcaagacttgttaaactatacccttaaaatgggtgcattttattgcatgttaattatacctcaatgaaacatatgccaattggcttttagaaccctattaaaagaagatttttttaacagaaatgtgatcacgtcaacatattatttgtaatccgctttttaattttgtattgaatttcaaaagttatgcatactcataaaaattcaaacaatgctgaattgaaaaaggaaaa

SEQ ID NO: 182900 - DNA, 876 bp, Homo sapiens
  Payload ID: 16034
  Gene Symbol: SLC13A3
  Gene Name: solute carrier family 13 (sodium-dependent dicarboxylate transporter), member 3
  ENST ID: ENST00000417157
  CDS Start-End: 128-685
ggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacaggaatagaacccaatactttcctctctgaggaaaggctgaaacttcaagctccccttgtgataagacttggtcagataactgagtctggtcaatggaatatgagtggaaatgatgtgtgcaacttccgggttctgtccttcctgccgggtggaatgtgaatatgatggcacctgggacccaaagacaggagccacatcttgagagatagatggcagatctgcccctgtggctttggatcatttacctcagtgaacacaacaagcattatccatgaaaccataggttttgtgtgctagttctagtttttaaaatatgaattaaattaaatacgtatctgttaaaacttaaa

SEQ ID NO: 182901 - DNA, 2008 bp, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENST ID: ENST00000413164
  CDS Start-End: 39-1697
agtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagcaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcat

SEQ ID NO: 182902 - DNA, 1597 bp, Homo sapiens
  Payload ID: 16034
  Gene Symbol: SLC13A3
  Gene Name: solute carrier family 13 (sodium-dependent dicarboxylate transporter), member 3
  ENST ID: ENST00000468915
  CDS Start-End: 372-1597
ttagccgggcatgatggcgggtgcctgtaatctcagctacttgggaggctgagataggagaatcgcttgaacccaggatgtggaggttgcagtgagccgagatcgccactgcactccagcctggacagggcactgggagtgtggcagggggcaattgggactcccttgttcccctggagtttaacctagtggtaaacactttcagacgacgaatcatgctatttggggattttgtacagggtgaggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagct

SEQ ID NO: 182903 - DNA, 1887 bp, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENST ID: ENST00000495082
  CDS Start-End: 192-1859
actgctgccctgagaacaagccggggcaggccctgccgcaggcctccttccccctctgcccccagcccaggcctccttccccctctgccctgagccctgggcctccttccccttctgccccgagccccgctgaccctctgagcatgcatctcctcctgcaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctg

SEQ ID NO: 182904 - DNA, 3283 bp, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENST ID: ENST00000472148
  CDS Start-End: 128-1690
ggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatc

SEQ ID NO: 182905 - DNA, 3971 bp, Homo sapiens
  Payload ID: 16035
  Gene Symbol: SLC14A1
  Gene Name: solute carrier family 14 (urea transporter), member 1 (Kidd blood group)
  Uniprot ID: Q13336
  ENST ID: ENST00000321925
  CDS Start-End: 233-1402
acacagagcagagtggggctctgagtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 182906 - DNA, 1390 bp, Homo sapiens
  Payload ID: 16035
  Gene Symbol: SLC14A1
  Gene Name: solute carrier family 14 (urea transporter), member 1 (Kidd blood group)
  ENST ID: ENST00000402943
  CDS Start-End: 319-1173
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatgg

SEQ ID NO: 182907 - DNA, 2264 bp, Homo sapiens
  Payload ID: 16035
  Gene Symbol: SLC14A1
  Gene Name: solute carrier family 14 (urea transporter), member 1 (Kidd blood group)
  Uniprot ID: Q13336
  ENST ID: ENST00000436407
  CDS Start-End: 548-1885
atgcttacaaagcgtggctagtatcttattacagaaaacagagcccacatcatgcatccttcttctcacatttcataaacaaggccaagggaaactgctgtggggcaacctgttgctttggtgttggtccccaagatgcagccctcacaatctgcccccaaacgtgtcagaacatgaaccccctcctccccctctggaagaagcaacctcagatccaacagcagagacacgcagcagaacaaaatctgggcattggtccctgtgtaggatggcttcccgttattttttttttaagcaaagtaaatgaacatcaaatttccatagtcagctgctgtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccat

SEQ ID NO: 182908 - DNA, 1554 bp, Homo sapiens
  Payload ID: 16035
  Gene Symbol: SLC14A1
  Gene Name: solute carrier family 14 (urea transporter), member 1 (Kidd blood group)
  Uniprot ID: Q13336
  ENST ID: ENST00000415427
  CDS Start-End: 166-1503
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgct

SEQ ID NO: 182909 - DNA, 1048 bp, Homo sapiens
  Payload ID: 16035
  Gene Symbol: SLC14A1
  Gene Name: solute carrier family 14 (urea transporter), member 1 (Kidd blood group)
  ENST ID: ENST00000535474
  CDS Start-End: 210-983
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttcca

SEQ ID NO: 182910 - DNA, 2371 bp, Homo sapiens
  Payload ID: 16035
  Gene Symbol: SLC14A1
  Gene Name: solute carrier family 14 (urea transporter), member 1 (Kidd blood group)
  ENST ID: ENST00000502059
  CDS Start-End: 301-1146
gcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctac

SEQ ID NO: 182911 - DNA, 572 bp, Homo sapiens
  Payload ID: 16035
  Gene Symbol: SLC14A1
  Gene Name: solute carrier family 14 (urea transporter), member 1 (Kidd blood group)
  ENST ID: ENST00000587601
  CDS Start-End: 488-572
agtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatatcttctcaactagactgaactccttaagtgcaagaaatacacgcttagtaaatgtttgttggaccagacactgcaccttatgaaattaaagaccagaacattctcatggtagcattacagacactgatggcaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatgg

SEQ ID NO: 182912 - DNA, 1022 bp, Homo sapiens
  Payload ID: 16035
  Gene Symbol: SLC14A1
  Gene Name: solute carrier family 14 (urea transporter), member 1 (Kidd blood group)
  ENST ID: ENST00000589700
  CDS Start-End: 1-909
atggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggaggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtga

SEQ ID NO: 182913 - DNA, 779 bp, Homo sapiens
  Payload ID: 16035
  Gene Symbol: SLC14A1
  Gene Name: solute carrier family 14 (urea transporter), member 1 (Kidd blood group)
  ENST ID: ENST00000590377
  CDS Start-End: 1-521
ctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagccctgttcacggcctatcttggagtcggcatggcaaactttatggctgagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 182914 - DNA, 569 bp, Homo sapiens
  Payload ID: 16035
  Gene Symbol: SLC14A1
  Gene Name: solute carrier family 14 (urea transporter), member 1 (Kidd blood group)
  ENST ID: ENST00000586951
  CDS Start-End: 263-569
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtct

SEQ ID NO: 182915 - DNA, 602 bp, Homo sapiens
  Payload ID: 16035
  Gene Symbol: SLC14A1
  Gene Name: solute carrier family 14 (urea transporter), member 1 (Kidd blood group)
  ENST ID: ENST00000589891
  CDS Start-End: 215-602
gtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaaca

SEQ ID NO: 182916 - DNA, 652 bp, Homo sapiens
  Payload ID: 16035
  Gene Symbol: SLC14A1
  Gene Name: solute carrier family 14 (urea transporter), member 1 (Kidd blood group)
  ENST ID: ENST00000589322
  CDS Start-End: 146-652
atctcctgagaagcactctcccttgtcgtggaggtgggcaaatctttatcagccactgccttctgctgccaggaagccagctagagtggtgtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttc

SEQ ID NO: 182917 - DNA, 1682 bp, Homo sapiens
  Payload ID: 16035
  Gene Symbol: SLC14A1
  Gene Name: solute carrier family 14 (urea transporter), member 1 (Kidd blood group)
  ENST ID: ENST00000588179
  CDS Start-End: 154-798
gcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaacc

SEQ ID NO: 182918 - DNA, 557 bp, Homo sapiens
  Payload ID: 16035
  Gene Symbol: SLC14A1
  Gene Name: solute carrier family 14 (urea transporter), member 1 (Kidd blood group)
  ENST ID: ENST00000590246
  CDS Start-End: 210-557
atcgcccggctaagcttggccctggcagatgggtcgcaggaacagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggag

SEQ ID NO: 182919 - DNA, 552 bp, Homo sapiens
  Payload ID: 16035
  Gene Symbol: SLC14A1
  Gene Name: solute carrier family 14 (urea transporter), member 1 (Kidd blood group)
  ENST ID: ENST00000586056
  CDS Start-End: 145-552
aagtgttttaaccaggacacaggaatatctgacagcattttctttgtttccaattacagctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttt

SEQ ID NO: 182920 - DNA, 2846 bp, Homo sapiens
  Payload ID: 16035
  Gene Symbol: SLC14A1
  Gene Name: solute carrier family 14 (urea transporter), member 1 (Kidd blood group)
  Uniprot ID: Q13336
  ENST ID: ENST00000586142
  CDS Start-End: 1293-2462
atttgttagctatggtaaatggaacaatgatggggccagaaatatccatgaggaccatttgatcacagcctggcaacacagagaagacaggctggtttctctatgtgggctttcagtgtttctttggtagtgtcttatgtggctgtggcttcaacattccacaattatgccttccagggtctgatgattttggcgtttccctgcttcccaattgacctggctgtgctgttggctgttcttgcacactcaaggtggttttgccattggcttcctccctcagcctgcctctgggattatgccactgctattcttttttatctaccatcagcacaatgaaatcatcatttttgtcttcaaggtaccaaattctggtgatattggtgctttcttgcagctacttatcatgagaagtgaatggtctcatagtgaacacagtcatggttatagtgttcatacgttccagagacatgtttcctataattatgccctgcacatttttctatcatacaatccttagattacagctctttggttttcaacagctttgtccaattccatctttcccagtttctctaccttgatgaaatatccttcttgcctggttttacatatttaaataacaaattccaaaagtaaagagtatctgaggcagtcacatgacataaggacaaattcaagccatcttggacttgcagagggtggggagaccgtgtcaacacacacaattttaaaaatttcttccctttcaatcttttaaaaacaaaactttttataaaataaaaatgtaatttaaaaaggctacctgtcttggcaagtagctgatcagcctgcattggtgagcaggccattccataacctggtttcttgctccttaattgacagcatggagctaacgtacttaatttcagctctttctacgtgatttgactcattctgttaacattaactgtttttcagtcttctcaactagactgaactccttaagtgcaagaaatacacgcttagtaaatgtttgttggaccagacactgcaccttatgaaattaaagaccagaacattctcatggtagcattacagacactgatggcaaaggtactgtgggatttgggtttggctaataagctctgtggtggtgtttcagaaggaaaatggtgctctcttagttctatggaacatagtggtccagatcttctactgtaaccaggcccaaagctggctaatctggagggctctgccttagggatacttataagctctgtccttccctcaaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaacc

SEQ ID NO: 182921 - DNA, 3823 bp, Homo sapiens
  Payload ID: 16035
  Gene Symbol: SLC14A1
  Gene Name: solute carrier family 14 (urea transporter), member 1 (Kidd blood group)
  ENST ID: ENST00000619403
  CDS Start-End: 233-1141
acacagagcagagtggggctctgagtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggaggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 182922 - DNA, 4746 bp, Homo sapiens
  Payload ID: 16036
  Gene Symbol: SLC14A2
  Gene Name: solute carrier family 14 (urea transporter), member 2
  Uniprot ID: Q15849
  ENST ID: ENST00000255226
  CDS Start-End: 817-3579
ttttttttttttttttgagacacagtttgctctgtcacccaggctggagtacattggcactatcttggctcactgcaacctccacctcccaggttcaagagattcttctgtctcagcctcccagtagctaggactacaagtgtgtgccaccacaccctgctaatttttgtatttttagtagagacagggtttcaccacattggccaggctggtctcgaacttctgacgtcaagtgatccacccgactcggcctctcaaagtgctgggattacaggcgtgggccgccgcacccggccatttgcttttgattttactggctcataggtggaagggacttgccttgcctcagatgaaactttggactttgactttcaagttaatactggaataagttaagactttgggggactgttgctaaggcacaattttgttttgaaatgtataaagaacataatatctgggaggggccaggggcagaatgatatggtttggctctgtgtccacacctgaatatcatctcaaattgtaatcccagtaatccccatatgttgagggcaggacccagggcaaggtgactggatcatgggagcggtttcccccatgctgttctcgtgatagtgagtgaattctcacaagatctgatggttttataagtgtttggcaagttcctgctccacaccatctctctcttctgccgccatttgagaaggtccaagtttgcttccccttcgccttccaccatgactgtaagtttcctgaggcctccccagcaatgtggaagttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagtcccagctacttgggaggctgaggcaggagaatggcgtgaacccgggaggtggagcttgcagtgagccaagatcacgccactgcactccagcctgggcaacggagtgagactctgtctcaaaaaaaaaaaaaaggggaagtcaccaagaaagggatagaggtcagtgacatggtcatcacacaactcggtcatttaatatggcaaaacacaataccaagaactgtgcattagcccggaaggcaagagggttggttctgccccagctctgctgctaatgagcccctaccaggttgagcaagtctttccccactctccacctccatttcttaatcagtttcatgacagggaaggatttgaaagtcctttccacctcagaagtgttgattattctctctctcctataatctgatgaaatcagcatgacaacaagtaatttaagtaaaggacagaagggttacccaagaagaggcaggaaaatgttaacgttctataaagttttattcttgagtcataggaaaatgctctccagacgtggggttaggaacctaaattcactgaaaatgccaatgtgctttcctttacattacagaaatatttctggaagtgtcagatgaaaactgatctttatcaacactcaaatcatattataaacaaatgtgtttccctttgtaatattcataatcatactgtcattaaactgtttaagtttgc

SEQ ID NO: 182923 - DNA, 1729 bp, Homo sapiens
  Payload ID: 16036
  Gene Symbol: SLC14A2
  Gene Name: solute carrier family 14 (urea transporter), member 2
  ENST ID: ENST00000323329
  CDS Start-End: 101-808
atctctctcttctgccgccatttgagaaggtccaagtttgcttccccttcgccttccaccatgacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctggatggagacggattttaactggagtaagagtggatgctggaagcatctgctacaataatccacaattgtctgctacaaaaccccacagagatgacagtgtttagattagagtgatatccatgaacatgccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggtgaatagccatgttcggggaagaaacgctctttgcctgacctgatgtcctctccctgtgttctctgctctggttcaatcagttgcagcactcaccttctttgcctctccttgcacctgtgtagaaccaagcacacctgtaactttctttccctgaagctgattttcattctctgccagaatctccataactatctattgtgcgacattaagggatgttggtattacagtaaaatttccggagttagc

SEQ ID NO: 182924 - DNA, 3461 bp, Homo sapiens
  Payload ID: 16036
  Gene Symbol: SLC14A2
  Gene Name: solute carrier family 14 (urea transporter), member 2
  Uniprot ID: Q15849
  ENST ID: ENST00000589658
  CDS Start-End: 125-2887
gattgtttcttgcttactacttgtggtcaactaagtagagattcataagacctttatagaaccactgacaacactgtgaccaaggaaacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagtcccagctacttgggaggctgaggcaggagaatggcgtgaacccgggaggtggagcttgcagtgagccaagatcacgccactgcactccagcctgggcaacggagtgagactctgtctc

SEQ ID NO: 182925 - DNA, 3540 bp, Homo sapiens
  Payload ID: 16036
  Gene Symbol: SLC14A2
  Gene Name: solute carrier family 14 (urea transporter), member 2
  Uniprot ID: Q15849
  ENST ID: ENST00000586448
  CDS Start-End: 322-3084
gtaagctgcctccatcatcctaaaaaacgaccatgctgaaagagctcctctgtatttcttggcagaccctttccagttttcatcctgggtgtttctgaacaggaacatatctcattgaagtatttgcacctctacctacagacaaggaaaaggcttggagcacctccattcattgtgccaacaggacctgaatgaccgattgtttcttgcttactacttgtggtcaactaagtagagattcataagacctttatagaaccactgacaacactgtgaccaaggaaacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagt

SEQ ID NO: 182926 - DNA, 3106 bp, Homo sapiens
  Payload ID: 16037
  Gene Symbol: SLC15A1
  Gene Name: solute carrier family 15 (oligopeptide transporter), member 1
  Uniprot ID: P46059
  ENST ID: ENST00000376503
  CDS Start-End: 57-2183
cacctgccaggagcacgtcccgccggcaggtcgcaggagccctgggagccgccgccatgggaatgtccaaatcacacagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctacaatgccagcacataccagttttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttcttttttctttttcttttctttttttttttttttttttttttgagacagagttttgctcttgttgtccaggctggagtgcaatggcacgatctcagctcactgcaacctccgcctcccaggttcaagtaattctcctgcctcagcctcccgagtggctgggattagcggcatgcaccaccacgcccagctatttttgtatttttagtagagatggggtttcaccatgttggccaggatggtctcgatctcttgacctggtgatctgcccacctcggcctgccaaagtgctgggattacaggcttgagctaccgcgcccggccgtgaacgctattttctaagcagccagcagtgaatctaaaactctggaagaagtcttctgtttgaaaggcttatttaagccacacgtacacacactgtcttagagtactgtgagcccaccccacattggtcatcttccctatcacacaaatgatgttattttggactagcttaattttgaaatggtaacaaagtttcctattccatactgttcatttctaatactcttacgaaaactattctaaaggaggcaggagccaaggccaaaagtgaacgtacaggtttgaaatggctgtgataaggaccagctggtattaactgataactttacctttgggtttttgttattttgtttttctagtccctacctgtgtttaaattatggataactcgaaagacagctcaggtgaaggccagtaatgatttttttgaagtttcaatggtgtgaaataaatttctgttcttaa

SEQ ID NO: 182927 - DNA, 2270 bp, Homo sapiens
  Payload ID: 16037
  Gene Symbol: SLC15A1
  Gene Name: solute carrier family 15 (oligopeptide transporter), member 1
  ENST ID: ENST00000618992
  CDS Start-End: 57-2177
cacctgccaggagcacgtcccgccggcaggtcgcaggagccctgggagccgccgccatgggaatgtccaaatcacacagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctaccagcacataccagtttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatg

SEQ ID NO: 182928 - DNA, 1619 bp, Homo sapiens
  Payload ID: 16037
  Gene Symbol: SLC15A1
  Gene Name: solute carrier family 15 (oligopeptide transporter), member 1
  ENST ID: ENST00000613008
  CDS Start-End: 67-693
cagtcaccggtaagttactgaatctgcgttggctgcctttcatgccactggtgctcctttgtggctatggaccagtggggggtgtatttcaatcctgtgcttgtttctttttgtcagagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagaggtaagagatacctgaaaggaacttctgttggtcttttttagtaaggccaagtccgtgtcttcttcgttttgttctgttcttcccttctgccctgttttctagctgtcagctacatgctgggatgcacgttggaatctggagtaagtgcttccttccctgtgagtttcacctcctttttgtcttatttaaatcccttatcccagtgaccactggagagtctaagccatccttagcatgggcatccatcttcctaaactgttattcatgcaaagtcatgctcgtggtaagaggtaagaggcaagagaggtgccttggaagccaagctggtggccgtagctgccattttagccttcaagctttgctccccagtgatatttctgtgacttaggaagagtttactgggcaaaattgtattgattttttgtttgttttgttttgtttttagaaggagtcttgctctgtcacccacgctggagcgcagtggcgtgatcttggctcactgcaacctccacctcctgggttcaagcaattctcctgcctcagcctcctgagtagctgggacaacaggcgcctgccaccatgcccggataatattttttgtatttttagtagagatgggatttcaccatgttagccaggatggtctcgatctcctgccctcgtgatctgcctgccttggcctcccaaagtgctgggattacaggtgtgagccaccacgcctggctaaggcaaagtttttttctttgctttcccatcatctcaagtatttccaaaagaactgctcagataaagagaatgggacagtgtcagtaactatcagaggtttgtgcttgctaatgctccatagagagtttgtgaatttcccatgtggaagggaatatgtggtgttactggtgacaaactaacaagaccatcctgtccacatttgaatcagattagattatgaaataaagatttcagggggatt

SEQ ID NO: 182929 - DNA, 2379 bp, Homo sapiens
  Payload ID: 16038
  Gene Symbol: SLC15A2
  Gene Name: solute carrier family 15 (oligopeptide transporter), member 2
  Uniprot ID: Q16348
  ENST ID: ENST00000295605
  CDS Start-End: 38-2134
aaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaaagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctgg

SEQ ID NO: 182930 - DNA, 5673 bp, Homo sapiens
  Payload ID: 16038
  Gene Symbol: SLC15A2
  Gene Name: solute carrier family 15 (oligopeptide transporter), member 2
  Uniprot ID: Q16348
  ENST ID: ENST00000489711
  CDS Start-End: 389-2578
attatatgcgtgaaccaccgcgcctgaccatggaatcagtttttcaatctgtgctcgaggtgttgtgttcttaactatcttctactcctttgcaaagataatctttcttaaacatagactttctaatcagttctctagcattgtttcattctgtctttggcatgttttcactttgctgtgctgtacttttacacattctttttaactatagcttcctgctttgctctggatcaggaagctattgaagctgacacccacagagttaaactgagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagttcgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaatacagcaattaatattaagatatcttaatatgaagtgcctggagtcaaatataacattccaaagtagtctgactggaagaactagcacctgcctttcttcaaacaatgcacttctgttaatgcagtgtaaggtaacatgagttgtttttggaaactacatcataatgtgggcttacattctagcacttatcacttaatgacagggatacatttgaggaatgcattgttaggcaattttgtcattatgcaaacatcatagagtgtacttacacaaacctatggtatagcctactacacatctaagttatatggtatagactgtttctccagctatatggtgtagactgtttctcctaggctacaaacctgcacagcatgttactgtattaaatgctgtaggcaattgtaacacaatggtatttttatacttaaacatatctaaacatagaaacggtacaaaaaactttacacattatatagatgtatcaaattattcatatgtgctctgaaaatgtctatatctgttatgtatcaattttttaaaaagtgaatgacataattcatttgaaaaaatgtggacacacaaattggaaaagaggtataaatgcagtattataatctaatgggaccacca

SEQ ID NO: 182931 - DNA, 572 bp, Homo sapiens
  Payload ID: 16038
  Gene Symbol: SLC15A2
  Gene Name: solute carrier family 15 (oligopeptide transporter), member 2
  ENST ID: ENST00000469013
  CDS Start-End: 116-572
agattgcataattctcaagctgtgagctgcaaagacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaag

SEQ ID NO: 182932 - DNA, 2115 bp, Homo sapiens
  Payload ID: 16039
  Gene Symbol: SLC15A3
  Gene Name: solute carrier family 15 (oligopeptide transporter), member 3
  Uniprot ID: Q8IY34
  ENST ID: ENST00000227880
  CDS Start-End: 235-1980
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 182933 - DNA, 801 bp, Homo sapiens
  Payload ID: 16039
  Gene Symbol: SLC15A3
  Gene Name: solute carrier family 15 (oligopeptide transporter), member 3
  ENST ID: ENST00000537307
  CDS Start-End: 1-743
agccaggggcttccccgcaagaggacatcgccaacttccaggtgctggtgaagatcttgcccgtcatggtgaccctggtgccctactggatggtctacttccagatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccag

SEQ ID NO: 182934 - DNA, 676 bp, Homo sapiens
  Payload ID: 16039
  Gene Symbol: SLC15A3
  Gene Name: solute carrier family 15 (oligopeptide transporter), member 3
  ENST ID: ENST00000536491
  CDS Start-End: 49-676
gaaggggcctggggcctggctgttgctgattgatccaaattctgggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctt

SEQ ID NO: 182935 - DNA, 691 bp, Homo sapiens
  Payload ID: 16039
  Gene Symbol: SLC15A3
  Gene Name: solute carrier family 15 (oligopeptide transporter), member 3
  ENST ID: ENST00000538739
  CDS Start-End: 245-691
gaaatggctgagtgtgaccaaatgatgcagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggcc

SEQ ID NO: 182936 - DNA, 456 bp, Homo sapiens
  Payload ID: 16039
  Gene Symbol: SLC15A3
  Gene Name: solute carrier family 15 (oligopeptide transporter), member 3
  ENST ID: ENST00000536784
  CDS Start-End: 1-132
ggcgccatcatgggcatcttcttctgcctgtcgggggtgggctcactgttgggctccagcctagtggcactgctgtccttgcccgggggctggctgcactgccccaaggactttgctgaagaggaattgtagacacccctggagatcttcaggaagtcaaacattaggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 182937 - DNA, 1807 bp, Homo sapiens
  Payload ID: 16039
  Gene Symbol: SLC15A3
  Gene Name: solute carrier family 15 (oligopeptide transporter), member 3
  ENST ID: ENST00000541505
  CDS Start-End: 96-1466
gggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 182938 - DNA, 2115 bp, Homo sapiens
  Payload ID: 16039
  Gene Symbol: SLC15A3
  Gene Name: solute carrier family 15 (oligopeptide transporter), member 3
  ENST ID: ENST00000618622
  CDS Start-End: 235-1176
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggtttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacgac

SEQ ID NO: 182939 - DNA, 1805 bp, Homo sapiens
  Payload ID: 16039
  Gene Symbol: SLC15A3
  Gene Name: solute carrier family 15 (oligopeptide transporter), member 3
  ENST ID: ENST00000621824
  CDS Start-End: 96-1037
gggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggtttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacg

SEQ ID NO: 182940 - DNA, 2779 bp, Homo sapiens
  Payload ID: 16040
  Gene Symbol: SLC15A4
  Gene Name: solute carrier family 15 (oligopeptide transporter), member 4
  Uniprot ID: Q8N697
  ENST ID: ENST00000266771
  CDS Start-End: 41-1774
aggtgacccggcggcggggcgaggcagctggcggcgtcgcatggagggctctgggggcggtgcgggcgagcgggcgccgctgctgggcgcgcggcgggcggcggcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccatga

SEQ ID NO: 182941 - DNA, 761 bp, Homo sapiens
  Payload ID: 16040
  Gene Symbol: SLC15A4
  Gene Name: solute carrier family 15 (oligopeptide transporter), member 4
  ENST ID: ENST00000376740
  CDS Start-End: 1-467
gcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgt

SEQ ID NO: 182942 - DNA, 2402 bp, Homo sapiens
  Payload ID: 16040
  Gene Symbol: SLC15A4
  Gene Name: solute carrier family 15 (oligopeptide transporter), member 4
  ENST ID: ENST00000376744
  CDS Start-End: 1-715
gtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcc

SEQ ID NO: 182943 - DNA, 1901 bp, Homo sapiens
  Payload ID: 16040
  Gene Symbol: SLC15A4
  Gene Name: solute carrier family 15 (oligopeptide transporter), member 4
  ENST ID: ENST00000614634
  CDS Start-End: 186-749
gtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggccgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcg

SEQ ID NO: 182944 - DNA, 2923 bp, Homo sapiens
  Payload ID: 16041
  Gene Symbol: SLC15A5
  Gene Name: solute carrier family 15, member 5
  Uniprot ID: A6NIM6
  ENST ID: ENST00000344941
  CDS Start-End: 1-1740
atgtctgttacaggctttaccataactgatgagaaagtacacttatatcacagcattgagaaggagaaaactgtaagacatattggcgatttgtgttcctcacactctgtgaaaaaaattcaggttggaatctgcttgcttctggtggagctgtgtgagaggttcacgttctttgaagtcgtctgcaacatgatccccttttgcactatcaagcttggctatcacaattgccaagcagccatcttaaacttgtgttttattggaacttcaatacttacccctgtgtttgtcagatggctcactgatgtctatttaggaagaaacaaactggtgtacatttgcttgtttctacattttctaggcactgctttgttatctgtggtggcttttcccttggaagatttctatctgggcacttaccatgcagttaacaacataccaaaaacagagcagcacaggctgttttatgtagcactgctgaccatttgccttggcattggaggcgtaagagccatcgtctgtccactgggtgcttttggccttcaggagtatggatcacaaaaaacgatgtctttttttaactggttttattggctcatgaacctaaatgcaactattgtgtttctgggaatatcttacatccagcactcacaggcctgggcccttgttttacttattccttttatgtctatgcttatggctgtgataactcttcatatgatatactacaacctaatttatcagtcagaaaaacgttgttctctcctgacaggcgttggggtgttggttagtgcactgaaaacatgccacccgcaatactgccatcttggcagagacgtgacaagccagttagaccatgccaaagaaaaaaatggtggctgctacagtgagctccatgtagaagacacaacatttttcctcacccttctccctctcttcatttttcagctcctatacagaatgtgcattatgcagattccttcaggatattatctgcaaactatgaattccaacctgaatttggatggatttcttctgccgattgcagtaatgaatgccatcagcagcctaccattactaattctggctccttttctggagtatttcagcacctgcctgtttccctctaagagagttggatcatttctgtcaacatgcatcattgctggaaatctttttgctgcattgtctgtgatgatagctggcttctttgaaatacaccgaaaacatttccctgcagtggagcagcccctttcaggaaaagttctcactgtttcctccatgccctgtttctacctgattcttcagtatgttttacttggagtggcggaaacactggtaaacccagccctctctgtaatatcatacagatttgttccaagcaatgtcagaggaacctccatgaattttctgacactgttcaatggatttggctgtttcacaggggcactgctggtgaagttggtatatctcatctcagatggcaattggtttccaaacacattaaacaaaggcaatttagaaagcttcttcttcttcctggcatcattaacattgttgaacgtcctgggattctgcagtgtttcacaaagatattgtaatctaaatcattttaatgcccagaacatccgtggaagtaatcttgaagaaacacttctcctccacgaaaaatctctgaaattttatggcagtatacaggaattttcttcaagtattgatctttgggagacagccctatgaaactgtgtttgagtctacctgtcttatgagaacagtattcattgttttcttcttcagttgagcattttatgtgttttagtgtaaaagccaatatatacagaggtgattttacaaatatcatctgtatactttatttacaaagactaattatgaattttctagtaaactgtcatgcttttgcattaacatgttatagcattagaattaataaaataatttcaaagtctcagtgattactctatgacaaaaaaaatgacagttttctatacaccaataataccttacagctttctacaatggttcagccattgaaagcgtatgaccttttttttggagttttaatgagtcattagaagcaaaatgacagtattttaatatactctctttcaatacacttagtgatcccttattacacgtgaccttattacattgtgaccatatactgtatataactgagtaaataataaacatatacatgattttctatatttgctgttaatattatgctatcaaaatatgacttcattaaggacattttctctgaatttaaaagcagtattactaaaatagatgtccttaacaaagagaatgtccgcatactaaaaaagttgaaaaataaatgtaagttatggaattattggaattaaaagaaagaaggaaattagggaagataaaatgagggggctgagaggagggtaagtgaccaaaccaaatagagatgcttaaaggaattatatgaataacatctttcggtctccactgccaattcagatgcattcagaaaattatcttctaagagtttcttctttcataagcaaaaatatgtggaaactcattttttaaaaaatcaaataaaattaaagtctgtttctcagtagcagtatttgtcaacatttggttgaggacaacttgctacaggtgaatctttctggcccctatacagactgccttaactcaaatctttttttgagattggggtccagcaattggtggttttaataagcacacccaaatcattctcatgttccctaaggtttaaaagccattgctttccaggacaattcatgttggataggacaggtgagtttatcagctgactgcaaattattctgcaattatgcacctcccttgtgtatacataaaatattttaggtctgtagaataaaagatttactcaacttga

SEQ ID NO: 182945 - DNA, 10051 bp, Homo sapiens
  Payload ID: 16042
  Gene Symbol: SLC16A10
  Gene Name: solute carrier family 16 (aromatic amino acid transporter), member 10
  ENST ID: ENST00000368850
  CDS Start-End: 487-1092
ttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatctcaacatctgctgcaatttgactgttcagatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaatctacattttgaccatactaccctttcatgtccttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaaataaaaaaaaaaattaggccaagcatagtggctcatgcctgtaatcctagcactttggtagtccaaggcagggggatcacttgagcccagaagttcaagaccagcttgggtaacataatgagaccctgtgtctacaaaaaatttaaaaattagccaggcatgatggtgcccacctgtagccccagctactcagaggctgaggtagtggaaggattgcttgagccttgagatggaggctgcagtgagctatgccactgtactctagcctgttcaactgagcagaaccctgtctgtaaaagaaaatcaaaaacaaaaaataaatgttaaattttgttttaagttttagcacagactcccctcaaaacaccttctccccaattttacagaaagtaatttaaaaatgaaaactttactctgtaaagacctctacagtgtttttcttttcaaaatttggctgattttaggaaaaaagtgatcatctgaaactaaaagaaattgcttggttagtttccatattaaaacagcagtgacaagtatatataacttagatctcagcatatgtgtttgtatattaaacttcacatatgtagttttcagtttaatggaatgaatcaaactggatctataacactgaaaaagttctattgtaatagactcatacggagaatactctgctataataatataaaattaagaagaaaaagtataaacgtaagatgctaaattccataaatgcatatttagtactatgttttttgtgggaaaagttctaaaagtttaaaatgcacaaagaaaatgaaaaatactaatataaaaatttgtgctttaatctagtcaaactaaatcctttctaatttctgaatgaagtgttactgctgcaataaagtgacctgataagcctaaattttttgtgttcaatccagacacttttctgagagtctgaaaagaatacagagtcagaactctgtttttatctcctcatcctgtttttgataagactcagaaaattctcaaattcgaaaggttctggcatttgaggccaaaaaaagcatgaaagggagtaacattcctttttatagatactctagattggatactattgtaacagatggccaagaaacttccagaaacattttggttaaattttattgcaatggatattgctgggatccatccatttaagcagtaatataccacccagattattgatactttatgcaagatgtgttcatctctttgatcatatttacaatgcttactccatagccctgctacaagacttaaaatttccactgaaaattgcatagttcttgtattaagattcaaattctggctgggcgcagtggctcacgcttgtaatcccagcactttgggaggctgaggcaggcggattgcctgagctcaggagttcgcaaccagcctgggaaacacggtgaagctccatctctactaaaatacaaaaaaattagccaggcgtgtcggcatgcacctgtagtcccagctactcgggaagctgaggcaggagaagaatccaggaggcagaggttgcagtgaggcgagattgcgccactgcactccagcctgggcgacagagcgagactccatctcaaaaaaaaaaaaaaaaagtaaaagtacacacagtttaaaagtaaacatgtttacttcggataattctaatccttttagctgcatttaagaatattttaatttatacgaatgttacttgaaattggcctatgtccagatgacttttgatgttaaatcaatggaaaactgaatagaaaatatgacacgagatcggggagggggaaggcaacctatagcatgggtggctctgaggagttcctgctggtgcactttcatgccctttcttatgtaccttttgtcttactcttcttacattattcttatcctcatcattttttcatttccctttacttcctcctatccttcaaaaacctcctgaagagtccattaacatccatgcttagttccactggttgcatggctgtatttcctactgatccctgtagtttcactgaatggatccccacccaatttcgtgtatcctggtgaatggctttctctcagccttcgacttagttctaatgatctacattgaatttaaattacatgactgaaatatttaagggaagaaataaatttcatacaaattagtatcttttatgctaacatttaaaactgtatttaaatttttaaggtaaatgctttggggaaaaaaaaaaccattgccaagtctttagcatattttcagagagcgtaattttttactttgatttccagtttcactaaggtttcattaaatcttagttccgagagcccagcatgaagggtgactgggaatgtagtgtgcctctctgatgcagttcctaatgattgttcttcagggaccttccttaggttaggttacattttctggtgaatggtgttagagtaaattcccagagtttagagatacaagtagaaatgcataagctaattagctccaattttataatatgtaaacaatttaaacaagtatttaaaactttttaggaagtctctaacactgaaaaaaaggtcattgttgctggtataaacattaaggagcaacttttacattaggtcaaagattgttgcttttccagtgtgttgtcttaaaaatagaaggaaataaaactattaccttctttttacatctatatgtttttataatttgaaaggcaagtagtatcttggtgaataagaaatgcatcatccataacaatttaattaactcttaaaaagaccagctttttgtcttgttatgaaaacaaaacgcaatttgtcattcataatggtaatgtggaataagaatacatcgtagaaggaagacttgctactttactgacttaatcattagttctaaggccatgtgtggcggctcacgcctgtaatcccagcactttgggagtccaaggcggtaggatcaccagagcccagggttcaagactcagcctgggcaacatagtgagatttcgtctctacaaaaaaaatttagccagcttggtggcacatgcctgtagtcccagctactcaggaggctgaggcaagaggattgcttgagcatagcaggtcaagtctgcagtgagctgtggttgcaccactgcactccagcctgggtgacaaaatgagaccttgtctacaaaaaggaaaaaaaaatttgttctgctctactatacatgctgacttttgttgatagcttggtctaaaaagactgtctagagctgaatttaagaatggttctggagcaaataataacaaggtagacaagcaggccctgggctcactataatttcatagccacgacctgtttattattagttggcagagattaatgctttgtgttataaatatactatagaacaataggtcacgattctcaagaacaaagccgaatgctcgcagttaagtgtgaagcttgcataagtgtcggaaccacaattatggacccaccatcaatgtgcattttatcagatgactcctcctgagacagtaaagactcctggaaaattcatgacatctttgaatcactcagaaaaatcttgaaactcaggacgtagtttacttagcttgccttttttaaaattatcaaattttaaatcgtaaactttgtcttcacttccacacgttcaaggacacctcttttaaagttcagtgttccatactaaaggggtgtaatcttgctttctggggaaataaaattccccatggtactatattcctgacagatataaaataacatgaggctacctcatttttgaaatagatttcaatatttttattagtaagttggaaagacagtaggaacaaaatgaaacctttctaagtacttgatgacacccacttgatcatgacaattcatctacctccgctttccgtgtccagctgaaagcccagctgagtcaactcctgcttcatcagaagggagctaatggtgattctgggattaaaaagcaaggggggtgcaaattgttagtggggtcaaaatatcagtaaaatttcttaagtgctttgttctgataaacggatgtaaaagtaacaaaaaaggaataacaactaatatggcctgtggatctgacaaagaaaaacctgaagaaattcagaatctagatacacttagattctaaattagacacactcagattctaatgaacacttagaatgcttcgccagtggcttttcaagttacactggaagcttgattatgaaaaagttttgttttcattggcaagagggtagatgatcagtgatgacagattgtacagctgtgcccaaacctgacaacttacacattaaactcctgtaagagacactccttcctagtagaacaaggactgggacaatgaatttttgactcactggagttttttaaaatgctgttcttgagtgtggcaatagtgtaggagttaacccagtctacccaaagaagttgctttgcctttcaatatgagtgctataaaaagagtattttggagttcaatgtccctaaacatgtatgcgataggaactaccaatataaaataacacttagaactcaaattagattggtaatactattttggagcctgtgatgtatgacttttattctttactagatatttttcagtatccgtcattagaagagtcagtttgttaaatattttaaatgtgtaaacacaaaacctttctactgtgatcttccctaatgagtcaaagtatctttcataattcagtctatattgaaatgttatttcaggaatggagggtttgttattaatagtgctgggccgggcacggtgactcatgcctgtaatcccagcactttgggaggccgagacaggcgaatcacctgaggtcagatgttggagaccagcctgaccaacatggagaaaccccatctctaccaaaaatacaaaattagccgggcgtggtggctccatgctgtaatcccagctactcgggaggctgaggcaggagaattgcttgaacccaggaggtggaggttgcagtgagccaagattgcaccatagcactccagcctgggcaacaagagcaaaactctgtctcaaaaaaaaaaaaaaaaaaaatagtgctgcattttgaccctggactatgaacagactgtatagttggtgcctcttttttttctaccaaagattattagatcaagattggtgctatacttcatgttcctttcaaaattatttttcttttaaaaatattaatatacaacacaatagaaaatgtatacagccagcaacgttatgcatgttgcatgttatatacatgactgaggaaaaaagctcacctatacagtgattattgagttccagtatctagttagaggtatgcaatttttgttaacatataagactttaaattacgaaactcacaagaaaatgatcaccaaatgagaatgttctaatgaacacaacctcccaaggtaataattttaaagaaaaagtcccttgtcaatgtttctagcacaaagtgagggatttaaatatattctgtaactttgaggcaatgtgaaaaagttatatataatagcttcctattgagctggcttatgtagacatttggacatttgaaactatttcgcaactttcaggctaaaatcagagttttgagagtcatcaatcttaaaacatggataatgagttatttgcacagttatatttttataattatttgaaatttatcactgaaagtatcattgtttgtctttcagatttaacataaacaataagtactgcggctgggtcactgtcagcaaatctcaggtctatgatttatcaagggctctcagcaccatcgttggtctgattgtgtaacacctaagtaaaataacatatgggtctccttggccaggcgccgtggctcacacctgtaatcccagcactttgggaggccaaggcaggcggattgcttgaggccaggagttcgagacatacgggtctctttaatgttctgtaggtaggattcagatgaattgagaatgacaggtttctttttctttctttgtttcttttttttttttttttttgagatggagtcttgctctattgccaggctccatatagtggcgcgatctcagctcactgcaacctccgcctcccgggctcaagtgattctcgtgcctcagtcttctgagtagctgggactacaggtgcccactaccacaccggctaatttttgtatttttggtagagatggagtttcaccatgttggccagactggccttaagtgatccacctgcctcagcctccccaagtgctggaattacaggcatgagccaccatgcccggctagagaatgacaggtttcagttgaattcttctcttttaaaagaccctgacttaactgtattttatgaggattttataaatgtaaattaagaagacaatacacactctcattttcctaattagaaagactatgcattcacaatccagtacactggatttgctctggtaactaatgataacacttttctacgttaacatgagttatatttggcagagagaatggaagcttgctaatcagaagttacattagggtgagattaaacatcactctaataataacttctgatgtaacttaatgtggtttgagatgtgtaagattgtagaggcattgcacaatgcttgataaaagttgcattttgcttttgttcttccaccagtttattttagccttaaagttatagctacaacaaattgaaccctgtagttattactgaaagagagtgtggatattttaagtatctcctagtataatatgacattgttcatgtggacttattttaatgtttatttgaaaattaattttttaattattttgtatattttgagttagaaaaacacactttatcttagacaccaaagccaaattattccaagtgtatgctatacaccgcagtgcagctctgcttctctcccaacctaccctggggccatttttggcacaatagttgttcaaatgtagatcactatgctgaatgctcatgctggatttgaccagtatgcagtattttagtactttttaaaaaatgtatgcttctttttgaagactataatttacaatttttttaataatgtgcaatttaatatagataaccaaaatctttttaatgaaaagatctttacaattgcttggaggataagattattttactgtggaaaaatgtgatactcttagtaaatgcaataaaaactttttagcaaattcc

SEQ ID NO: 182946 - DNA, 2508 bp, Homo sapiens
  Payload ID: 16042
  Gene Symbol: SLC16A10
  Gene Name: solute carrier family 16 (aromatic amino acid transporter), member 10
  Uniprot ID: Q8TF71
  ENST ID: ENST00000368851
  CDS Start-End: 176-1723
gcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagata

SEQ ID NO: 182947 - DNA, 646 bp, Homo sapiens
  Payload ID: 16042
  Gene Symbol: SLC16A10
  Gene Name: solute carrier family 16 (aromatic amino acid transporter), member 10
  ENST ID: ENST00000439288
  CDS Start-End: 1-620
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactgatcatgaatattactatttaataaaga

SEQ ID NO: 182948 - DNA, 912 bp, Homo sapiens
  Payload ID: 16042
  Gene Symbol: SLC16A10
  Gene Name: solute carrier family 16 (aromatic amino acid transporter), member 10
  ENST ID: ENST00000419619
  CDS Start-End: 1-635
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataattaatgtctagactggggttggtgcctcacgcctgtaatcccaccactttggggggctgatgcaggagttcaagaccagcgtgggcaacataaggagacttcatccctacctggggaaggaaaaaaaaaaaagaaggaagaagcagtgtctaaagtatctgcccctggcaacgtttgttcaaaagtgttcattatgtttcttccttttttcttttgtggctgaaaatgtatttacaattcaccgtaaatgataaaaatggcattggcacacatattt

SEQ ID NO: 182949 - DNA, 1231 bp, Homo sapiens
  Payload ID: 16042
  Gene Symbol: SLC16A10
  Gene Name: solute carrier family 16 (aromatic amino acid transporter), member 10
  ENST ID: ENST00000612036
  CDS Start-End: 251-1231
agtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaattttcaattttgccatcttcaaggtgacagcttatgcagtgtgggcagttggaataccacttgcactttttggatactttgtgccttatgttcacttggtgagtatgctccttcactgatcatgaatattactatttaa

SEQ ID NO: 182950 - DNA, 3910 bp, Homo sapiens
  Payload ID: 16043
  Gene Symbol: SLC16A1
  Gene Name: solute carrier family 16 (monocarboxylate transporter), member 1
  Uniprot ID: P53985
  ENST ID: ENST00000369626
  CDS Start-End: 364-1866
agagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagtataaa

SEQ ID NO: 182951 - DNA, 865 bp, Homo sapiens
  Payload ID: 16043
  Gene Symbol: SLC16A1
  Gene Name: solute carrier family 16 (monocarboxylate transporter), member 1
  ENST ID: ENST00000429288
  CDS Start-End: 220-865
tccacgtggccgaggtgcacaccccaacccactgggccagtctccccaccctcttacctgctcttctttcccgactcgtctttaatacccaccaggcgccaaccgccgcgggcctggctctatggtggcaagttgcatgggttctcccatcaggacctcccgatgagcctacgagatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgaga

SEQ ID NO: 182952 - DNA, 1099 bp, Homo sapiens
  Payload ID: 16043
  Gene Symbol: SLC16A1
  Gene Name: solute carrier family 16 (monocarboxylate transporter), member 1
  ENST ID: ENST00000443580
  CDS Start-End: 210-1099
tccagaatgaagttcagagaaacaaaggaatgaatgataacatgacaacatagaagggagagtaagagagtagatagcatgggaaggtccaacccatatccagttggagtctgagaaaagtgaaaagagagaatgggggagaagcaatatttgaagacataatagatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaa

SEQ ID NO: 182953 - DNA, 2201 bp, Homo sapiens
  Payload ID: 16043
  Gene Symbol: SLC16A1
  Gene Name: solute carrier family 16 (monocarboxylate transporter), member 1
  ENST ID: ENST00000458229
  CDS Start-End: 833-2201
gctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaaatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagc

SEQ ID NO: 182954 - DNA, 4374 bp, Homo sapiens
  Payload ID: 16043
  Gene Symbol: SLC16A1
  Gene Name: solute carrier family 16 (monocarboxylate transporter), member 1
  Uniprot ID: P53985
  ENST ID: ENST00000538576
  CDS Start-End: 833-2335
gctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaaatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagt

SEQ ID NO: 182955 - DNA, 4374 bp, Homo sapiens; identical to SEQ ID NO: 182954
  Payload ID: 16043
  Gene Symbol: SLC16A1
  Gene Name: solute carrier family 16 (monocarboxylate transporter), member 1
  Uniprot ID: P53985
  ENST ID: ENST00000628110
  CDS Start-End: 833-2335

SEQ ID NO: 182956 - DNA, 865 bp, Homo sapiens; identical to SEQ ID NO: 182951
  Payload ID: 16043
  Gene Symbol: SLC16A1
  Gene Name: solute carrier family 16 (monocarboxylate transporter), member 1
  ENST ID: ENST00000626371
  CDS Start-End: 220-865

SEQ ID NO: 182957 - DNA, 3910 bp, Homo sapiens; identical to SEQ ID NO: 182950
  Payload ID: 16043
  Gene Symbol: SLC16A1
  Gene Name: solute carrier family 16 (monocarboxylate transporter), member 1
  Uniprot ID: P53985
  ENST ID: ENST00000630362
  CDS Start-End: 364-1866

SEQ ID NO: 182958 - DNA, 1099 bp, Homo sapiens; identical to SEQ ID NO: 182952
  Payload ID: 16043
  Gene Symbol: SLC16A1
  Gene Name: solute carrier family 16 (monocarboxylate transporter), member 1
  ENST ID: ENST00000629508
  CDS Start-End: 210-1099

SEQ ID NO: 182959 - DNA, 2201 bp, Homo sapiens; identical to SEQ ID NO: 182953
  Payload ID: 16043
  Gene Symbol: SLC16A1
  Gene Name: solute carrier family 16 (monocarboxylate transporter), member 1
  ENST ID: ENST00000629920
  CDS Start-End: 833-2201

SEQ ID NO: 182960 - DNA, 2074 bp, Homo sapiens
  Payload ID: 16044
  Gene Symbol: SLC16A3
  Gene Name: solute carrier family 16 (monocarboxylate transporter), member 3
  Uniprot ID: O15427
  ENST ID: ENST00000392339
  CDS Start-End: 155-1552
agtcagttaggtaacaggccacgggccccgggctcaggccactgcacggacccagggaacgggctgacagtccagcagaggcctcagcgaggcggcggcgctgcgcacaaacctgaggacctaggcgggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagt

SEQ ID NO: 182961 - DNA, 2086 bp, Homo sapiens
  Payload ID: 16044
  Gene Symbol: SLC16A3
  Gene Name: solute carrier family 16 (monocarboxylate transporter), member 3
  Uniprot ID: O15427
  ENST ID: ENST00000392341
  CDS Start-End: 167-1564
acctggggaaacggaagttcagggagggcgaggccgtgccccacatccaggcagcgcaggccgcgggccgctcccctagccaggaagagccgccgtccgcaccgggaccggagaggaagcggaggtctgaagggggacaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagt

SEQ ID NO: 182962 - DNA, 2002 bp, Homo sapiens
  Payload ID: 16044
  Gene Symbol: SLC16A3
  Gene Name: solute carrier family 16 (monocarboxylate transporter), member 3
  Uniprot ID: O15427
  ENST ID: ENST00000582743
  CDS Start-End: 102-1499
ggagcggaccggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttagga

SEQ ID NO: 182963 - DNA, 808 bp, Homo sapiens
  Payload ID: 16044
  Gene Symbol: SLC16A3
  Gene Name: solute carrier family 16 (monocarboxylate transporter), member 3
  ENST ID: ENST00000583237
  CDS Start-End: 152-808
agttcagggagggcgaggccgtgccccacatccaggcagcgcaggccgcgggccgctcccctagccaggaagagccgccgtccgcaccgggaccggagaggaagcggaggtctgaagggggacaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagac

SEQ ID NO: 182964 - DNA, 955 bp, Homo sapiens
  Payload ID: 16044
  Gene Symbol: SLC16A3
  Gene Name: solute carrier family 16 (monocarboxylate transporter), member 3
  ENST ID: ENST00000583025
  CDS Start-End: 1-921
ctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggggtcctgctgtcacccaggctggagggcagtggcaccatcacagctccctgcagccttaacctcccgaactctagccatcctcctgcctcagcctccagagtagctgagactacagatgtaagccactgcacctggcctgtttctttttcctccctaccccccaaatgtctcagcagaaatcaccccttttgttagctgtaagtaacaatgtaccccgtcatccatggca

SEQ ID NO: 182965 - DNA, 545 bp, Homo sapiens
  Payload ID: 16044
  Gene Symbol: SLC16A3
  Gene Name: solute carrier family 16 (monocarboxylate transporter), member 3
  ENST ID: ENST00000577650
  CDS Start-End: 74-545
cggcgagaggcggcgagaggcgggctgaggcggcccagcggcggcaggtgaggcggaaccaaccctcctggccatgggaggggccgtggtggacgagggccccacaggcgtcaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgg

SEQ ID NO: 182966 - DNA, 535 bp, Homo sapiens
  Payload ID: 16044
  Gene Symbol: SLC16A3
  Gene Name: solute carrier family 16 (monocarboxylate transporter), member 3
  ENST ID: ENST00000578522
  CDS Start-End: 129-535
ctgctgctgcctcccagggcgctggttcacagcacggtcccagcagggagaggctgagccggttggactagaccacccaaggtctcaggttgcagctccctggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcat

SEQ ID NO: 182967 - DNA, 859 bp, Homo sapiens
  Payload ID: 16044
  Gene Symbol: SLC16A3
  Gene Name: solute carrier family 16 (monocarboxylate transporter), member 3
  ENST ID: ENST00000580098
  CDS Start-End: 155-859
agtcagttaggtaacaggccacgggccccgggctcaggccactgcacggacccagggaacgggctgacagtccagcagaggcctcagcgaggcggcggcgctgcgcacaaacctgaggacctaggcgggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcc

SEQ ID NO: 182968 - DNA, 866 bp, Homo sapiens
  Payload ID: 16044
  Gene Symbol: SLC16A3
  Gene Name: solute carrier family 16 (monocarboxylate transporter), member 3
  ENST ID: ENST00000578684
  CDS Start-End: 76-866
ggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcggg

SEQ ID NO: 182969 - DNA, 4830 bp, Homo sapiens
  Payload ID: 16044
  Gene Symbol: SLC16A3
  Gene Name: solute carrier family 16 (monocarboxylate transporter), member 3
  Uniprot ID: O15427
  ENST ID: ENST00000581287
  CDS Start-End: 2323-3720
tccttggccttgcatggcctgtttatttttaaaagtgcaaacttgcaaccccaaacaagctggggccctgaggccgtcaacccctccagtctcccctgtgacccgcagtctgcgtcctgttcccagtttcattcctcaagtgcatatatttttatttttttattttttttttgagacagagtctcgctctgtggcccaggttggagcgcagtcgcgcgatctcggctcactgcaagctctgcctcctgggttcacgccattctcctgcctcagcctcccgagtagctgggactacaggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctggtctttgcaccctgtcctccatccagcccggcccagcgcttgggcttgtcctggacacctaacacccacctgccctcgtggccagcagtggcctgcgtggctgggagcccggtcagaggccgccggggccctcagtaggtgcgtcgtgggcgctggggacggcagcgggtgccctggcgggccgcgtgcagccggagagatgccatgtccctgctcctctgcaatgaaaagcaagcgaaaag

SEQ ID NO: 182970 - DNA, 872 bp, Homo sapiens
  Payload ID: 16044
  Gene Symbol: SLC16A3
  Gene Name: solute carrier family 16 (monocarboxylate transporter), member 3
  ENST ID: ENST00000580189
  CDS Start-End: 204-872
tctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttc

SEQ ID NO: 182971 - DNA, 279 bp, Homo sapiens
  Payload ID: 16044
  Gene Symbol: SLC16A3
  Gene Name: solute carrier family 16 (monocarboxylate transporter), member 3
  ENST ID: ENST00000582715
  CDS Start-End: 41-279
cccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaagcccgtcctaccctgggctcacatggggcctgtgcccacccctcttgagtgtcttggggacagctctttccacccctggaagatggaaataaacctgcgtgtgggtggagtgttaggacc

SEQ ID NO: 182972 - DNA, 586 bp, Homo sapiens
  Payload ID: 16044
  Gene Symbol: SLC16A3
  Gene Name: solute carrier family 16 (monocarboxylate transporter), member 3
  ENST ID: ENST00000582946
  CDS Start-End: 96-586
agtgcagagggagtgggacccacagctgctagcctccctccaaaccctcctgcctccaccagacaccaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgag

SEQ ID NO: 182973 - DNA, 1033 bp, Homo sapiens
  Payload ID: 16044
  Gene Symbol: SLC16A3
  Gene Name: solute carrier family 16 (monocarboxylate transporter), member 3
  ENST ID: ENST00000584689
  CDS Start-End: 160-1033
cgcggagccacctggggaaacggaagttcagggagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggc

SEQ ID NO: 182974 - DNA, 2015 bp, Homo sapiens
  Payload ID: 16044
  Gene Symbol: SLC16A3
  Gene Name: solute carrier family 16 (monocarboxylate transporter), member 3
  Uniprot ID: O15427
  ENST ID: ENST00000619321
  CDS Start-End: 96-1493
agtgcagagggagtgggacccacagctgctagcctccctccaaaccctcctgcctccaccagacaccaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagt

SEQ ID NO: 182975 - DNA, 2048 bp, Homo sapiens
  Payload ID: 16044
  Gene Symbol: SLC16A3
  Gene Name: solute carrier family 16 (monocarboxylate transporter), member 3
  Uniprot ID: O15427
  ENST ID: ENST00000617373
  CDS Start-End: 129-1526
ctgctgctgcctcccagggcgctggttcacagcacggtcccagcagggagaggctgagccggttggactagaccacccaaggtctcaggttgcagctccctggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagt

SEQ ID NO: 182976 - DNA, 1934 bp, Homo sapiens
  Payload ID: 16045
  Gene Symbol: SLC16A5
  Gene Name: solute carrier family 16 (monocarboxylate transporter), member 5
  Uniprot ID: O15375
  ENST ID: ENST00000329783
  CDS Start-End: 288-1805
gcggtcctcgtcgcgaccggcccgggccgcaggacgccgcgctcgggggagctgagccacctctccgccaggcccgtgcgagcggtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaa

SEQ ID NO: 182977 - DNA, 2051 bp, Homo sapiens
  Payload ID: 16045
  Gene Symbol: SLC16A5
  Gene Name: solute carrier family 16 (monocarboxylate transporter), member 5
  Uniprot ID: O15375
  ENST ID: ENST00000450736
  CDS Start-End: 416-1933
gtctaaacttctccctgcccacacatccagcttcatggcactgtgctacaaagctggtctcattgggcctaggggtctttgagagctgagcttggcagcccctggggcccaacctcacccctagtcccagcaagtgagagcgaagcatcttgccctgtctacctccttgcccaaagcacacaccaggcagtgaccatgactcatggttcccagtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttt

SEQ ID NO: 182978 - DNA, 1842 bp, Homo sapiens
  Payload ID: 16045
  Gene Symbol: SLC16A5
  Gene Name: solute carrier family 16 (monocarboxylate transporter), member 5
  Uniprot ID: O15375
  ENST ID: ENST00000538213
  CDS Start-End: 129-1631
agagacaattgtaccccattgcctggtgccacctgccctgccccgtcctgtccctcctatccctcctgtccctcctgtccttcctgccacctcctgccaggctggctctgggaagtgggtgaaaggagatgccaaggccaacgcgtgggcctctggccacctcccaggggtggtgcccctctgtgacacctggtacttgggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtatgtaaccagcgtctaagacccagggttcatctgtgtgaccagtgtctgagtcctgggatcactgagtgaacactgtctcagcccagcccaggagggggacctctagctccttcaccaggggcttgggtgaagagtagcccaggaagcccgggctgtccaggctctgcaagctgggactctgccaggagctgggactttggaggctggcctctgaagatgccctgaga

SEQ ID NO: 182979 - DNA, 738 bp, Homo sapiens
  Payload ID: 16045
  Gene Symbol: SLC16A5
  Gene Name: solute carrier family 16 (monocarboxylate transporter), member 5
  ENST ID: ENST00000584207
  CDS Start-End: 130-738
tagtcttgaactcctgaccccaggtgagccgcctgcctcggcctcccaaaatgctgggattacaggtgtgagccaccgtgtctggcagggctgaattttgaaagaccagttgactggagaaaccgctcgatgggaggggaggctggagagccgactgggcatccataccgtgcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttcctt

SEQ ID NO: 182980 - DNA, 562 bp, Homo sapiens
  Payload ID: 16045
  Gene Symbol: SLC16A5
  Gene Name: solute carrier family 16 (monocarboxylate transporter), member 5
  ENST ID: ENST00000578847
  CDS Start-End: 403-562
agaaagagggcatccgggttgtgcaaatttcagacacacggatatcccgtggcgcctgcgtccggagcccggccctgctgctggactgtccccggccacgcccgccgcccctcccgcatcctggccccttccccacccgacggaatcccggggaggctggaagcacacaccaggcagtgaccatgactcatggttcccagtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctctt

SEQ ID NO: 182981 - DNA, 1688 bp, Homo sapiens
  Payload ID: 16045
  Gene Symbol: SLC16A5
  Gene Name: solute carrier family 16 (monocarboxylate transporter), member 5
  ENST ID: ENST00000578376
  CDS Start-End: 325-1688
gcggtcctcgtcgcgaccggcccgggccgcaggacgccgcgctcgggggagctgagccacctctccgccaggcccgtgcgagcggcacacaccaggcagtgaccatgactcatggttcccagtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcat

SEQ ID NO: 182982 - DNA, 2019 bp, Homo sapiens
  Payload ID: 16045
  Gene Symbol: SLC16A5
  Gene Name: solute carrier family 16 (monocarboxylate transporter), member 5
  Uniprot ID: O15375
  ENST ID: ENST00000580123
  CDS Start-End: 373-1890
agaagctagaaagagggcatccgggttgtgcaaatttcagacacacggatatcccgtggcgcctgcgtccggagcccggccctgctgctggactgtccccggccacgcccgccgcccctcccgcatcctggccccttccccacccgacggaatcccggggaggctggaagtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaa

SEQ ID NO: 182983 - DNA, 989 bp, Homo sapiens
  Payload ID: 16045
  Gene Symbol: SLC16A5
  Gene Name: solute carrier family 16 (monocarboxylate transporter), member 5
  ENST ID: ENST00000584118
  CDS Start-End: 282-989
ccctcctgtccttcctgccacctcctgccaggctggctctgggaagtgggtgaaaggagatgccaaggccaacgcgtgggcctctggccacctcccaggggtggtgcccctctgtgacacctggtacttgggtatgaggaagggatggcttagctgcccagagaaggtggcaggtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacaca

SEQ ID NO: 182984 - DNA, 11777 bp, Homo sapiens
  Payload ID: 16046
  Gene Symbol: SLC16A7
  Gene Name: solute carrier family 16 (monocarboxylate transporter), member 7
  Uniprot ID: O60669
  ENST ID: ENST00000261187
  CDS Start-End: 165-1601
gtatgttcaggattctaaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaatgataatttatttttaaggtaaaaataatccatgaagataaaagaaacatatgtctgcgtgctactttacaatgttggttttaaagataagcacatgggtaaaaatgagggtgatccttattcaaaaataacatctgactactataaaaatatttgcatatataagtttgacaaagaaaagaaaatcaatgttaaaccattaaatctgagcactgttagacttgattaatccatgcacatgattttttttgagtagggagcattagtacctggtgctagagaatagaaccctcaaataatttttagaattcttacctaatatgtaaaagtctgcatgactcttaacaatgagtcacatccattgattttacagggattttagttcgtaatccagaaagtaataatcagggattttattttaatcaggcatcaatccagattcactgttatactgaaatatcaaagtaaaatcctagttggcaggattgtaagtagaccgaattctaatttttcccaacacatagtggtaattggaggttactgttatgaatactccatctgactacgactaagagagtgaggggtggttttaatgaaccctctaagctctctcagttccttcccttccacaaaatgcaagagcaaaagcaaactacaaacaggccttgtgctcaaccactggaaatgcctcctgggataagaatggcagcacttgaaaattctgccctctactgatgagacttcctgctgcctttggacataactaagccaggaaactttaaaagccttctagaaatagaggcactgtatgacttgcaatcgtaggtatagtttataacctgatagcaaaaaacttgaaatattgcagcccagtttaattcagcactttcccattttcataactatgtgaaaacatctgggaatttgaatcactcctgaatacagaggcatattctttttaaactataaataccattttgagtgagaaagtacttttaaacaagaaagaaattgtacattatgactaaagttataaatacaatatttatatctataaatctgaagtttaacatgattaatttaaaaagtatttagtgcttgacaaagtagtgtcactcttaagatgtcaaagggaattagccattttttttattgtaataaaggcaggtgctatttttttctggtgagattgcacctggataccaggcttttgtaatagttaacattaaacatttgattcataaagttaattcactgcttaagcatgtggctcatatttaggaagctatataaaattcagtttttcatttaacatttgctcttttgcatatgaagagatatttgtatttttcaaatgttaagtaaaacaagatgtgccaatatcataggtaaataaattagggaaaatgtgggactttatggctgtttttaatttagtttcacccgatcttgattcttgaattagctatgtttatatttttagttcttttttattcaactcagatttgtcaagaaatgtaacctctaaattgtgtagtacctctccaatcataaattttcaaaaaaaaattctactttccaaaaagtgtcttgaattctctgaaaaggcacattaaactaatatgaacatcagataccagggggaaataaatggcaaagtaataatcatgaggttttaggtcaaagactacattatatatattttttattaccttctagtagagacatcctcctgggtgcatttcagtggccttctccagggaggaggtttatttacttactgatgagtttctcgtcacgtcaaaaccagttcacatttgtctggctgctctttggttgtcttcattcgttatttatttctaacactgtattaaattgttagaaaagaaagtaaaacttgcacattcaaagcacatgatttgtacagtcacacctggcagtagcactgcacagttacaaatatgcacacacgttaactgctatgcataaatattgacagttaaaccagaacacaattgaaacagtgacataaatacctacaggattcagaattgttccagggtaatataaattattctacttgttcactctccccaccctcttgaacttgttagaagatttgctgctttagcagaatctttccaagattgagaaaagtgtatcaacctaggattttcattactatatagtcacataaatggaggaggagatatatttggcttctgcctctgcaacaattagtatgaacatatttctttctctagggaataataggttttaaacatttgagatatcatgaagcaaagtcagggtataccactacaatccccactaatctctattcccacattatgaaattgtacagaagaaagggtgtcattaaatcaaggtatccagataattcatggctactttaactattttttcattcgtgttaactgagccccccatattttttactacttaaccttaaatatgccatcactaatttatgaatagaacattgtgtttgcacttttcctgacctatcctcaccccctttcctgatcctttttgcattcacctagcacaccttaagagacaaaaaatcaggttttagtgtatttcacattggaagacatgatgttttctcagtataaatctacaggactcataaacaatcacttttttggtgccaagtttcaaccctttagctcatggactcattggcctcagcctaatactaagaaacaagtaaaataattagattttctatgtttgaatgtgcactttaaaaaatctagataatttatactcattcttttctggctgtacaacatgacaatcaagaatatagaaaagaagactaaaagatatatgatataaatgtaagtttttatgtagatgacataaatatgaagagatattcttggtcagttggttgaaacattttttatctaaaacacctttaaaaaatccctttcatatgtagaatgtggaaggcttttaataaaacaaaaattattatttttaggcttaatttaatagggagattggatgcatagtggaaagggaactaatatttatatgttatgcattttgcttatgtaatgcctttcaatatgaaaaccaaaaccatggcagaattattactagcttgatatgacagatgagtgaaaacaaaaaacaagctcagcagactacccaaagttaaaaggtagtatgaaccaaaattaaaactcaggtttacgtaaccagaaagatccccgaggtgttcactaccgtgctgcctcccaatagaggccagagaagcaaaggaagataaaatataggtacaaaaaagatacatcctatatagtaaaacaattaggtttaactgtaacttgtattatgatttatttagtgtttattagagaactgcatttgctagaacctgaatatgtaatttctttctttctttctttttttttttttttgagactgagtctcgttcttgtcgcccaggctggcgtgcagtggcacaatctcggcttactacaacctctgcctcccaggttcaagcaattctcctgcctcagcctcccgagtaactggaattacaggcatgtgccaccatgcccggctaattttgtggctttttttgttttgttttgttttgttttgttttagtagagatggggtttctccttgttggtcaggctggtcttgaactctgacctcaggtgattcactcgcctctgcctcccaaagtgctgggattacaggcgtgagccactgcgcccagccttgaatatgtaatttctgattgcctgcttttctccccaatgcaaattatctcaaataatgataattattacatatagacataattacttcaatatgactctttttctcataaaaataatgacatatttgagtcaggcataatacattttttctgaggttggagttagcaggaaaatgttatcttttatgaataaataattcccagattggttgctacatatcatgattcaaaaagtaaaataattacctggatgtggtgatgtgcacctgtagtcccagctactcgggaggctgagacgagagggtcatttgagcccaggaagttgaggcttcagtgagctataatggccccacttgcagtccagcctaggcaatagagtgagaatctgtctctattaaaaaaaaaataaaatgttcttactagaaaacattatatttagaattttagtgattattccatttataatattatccgtagctaccaaaaaaaagattataagatacaaatgatttggtttacccatacagttacatattaattttcatcatttaatacaacttaccctacaccgtagcttatttttcaagtttctctgaacatctttgttgtcattcacctctttgtctatttgttctgtagagaaaacaagtgtcattgcttttgtcttctccatctagacttttgcagtccttagactatagttctccttagctctattcaaatagtgcacttgcaaggcgctgcattcttctcaaagtcagccatgatgcacatatttataattacatacacatataattgaatatgattttagagtcttgaaaaactgatcttctttggcactatcctgaatgtttctgattttcttaaagtgcctgacaatattgagtaacaaagcttaccatcaccacattgcaccattatgtattattctgtctccatcaatgcagtgacatcactgatacatcataccaacaagatttctaaccacaaccattcagagcactaattagcatctatattgagaatataagattaatattacaaacttgactttactcatctctctttaagattttgatttctgcacaaccatatgcagaactcatgtttgagaaggcacttaaaagctgaaaggcccaattatcagtaattataatgcttgcatgatcaaaattacaaattatctttgttgatacaattaaaaatgagtaattttctgagcttatgtcacttttttatagttctgattttctcttctttcctatcagttgtttgtacactggagattttagctctttacagggtgctacaatctggtttattttagtcttctctcctctactgctttttcttcactttaattcatttatgtgcaaatcagggaagaattgctgtagtattgagaatggtcattttaaaagtctctaccttaagagcaaaattaatattgcaaaatgaatttttgattttacagaagcatatgggaatttagatcaaattacatctcccatcccaatctcctgcttcttcatcatctcctaaatgttttcctttctatgtttttataatatctaggtaaaacttgtttagcattttttatttaattatggacatatttagtatggacttttgtttctttggtatagttagttacacttgtttgcatgatctacatgtttttcagtctccatatatacttgttaataaggtgagcaatattcaggaatatttcagtaggcaattaatgatcataaatttattcacatttcagtaaatatttttcacatgatcaaacaggattttttgtttctttttaatttaaatatggcaaaataagctagagaatctcagtgtgaaaacactgatactgaacattctattaaaatagaataagttcgtgtagggacatggatgaaattagaaatcatcattctcagtaaactatcgcaagaacaaaaaaccaaacaccgcatattctcactcataggtgggaactgaacaatgagaacacatggacacaggaaggggaacatcacactctggggactgtggtggggtcgggggaggggggagggatagcattgggagatatacctaatgctaggtgacgagttagtgggtgcagcgcaccagcatggcacatgtatacatatgtaactaacctgcacattgtgcacatgtaccctaaaacttaaagtataataataataaataaaataaaataaaataataaaaataaaaataaaatagaataagttgataaaagctcctctgttcagaaaaacaaaagaatggcattttatctcacataaatttaggatgaaattttaaaacattcttttgactaagactttaattcttatatgcatctaaaataaatgttttgagttagactcagtttatatagcttcctcgttagagtacacattttttttctcatcctccgaatctcaagagtacatatttctgacaagcttttcaatggtacgatggattttatttttctatcatcaactttctatatttaactaaagcattagtatttctagatttagtgaaatagcaaatatgaattaaaatatttatttctaaacattagatctaattgtattttgatttgttttgatatatttatgtctcagaagatatgtttaatgaattcatttcatcctctcaaccctcagttttgataggtatccacatttttaccatataaaactagactggattaaggattttgcctaaacctataccaatactctgaataaatgcagggttggagatagaattcaggtcttttaacttctaacacacttttttctccattgcactacagaagccgtaaggtcataatgatgatctttgtagagtaaataaaatattttcctagaaatatatataacaaccctacttgatagtttatagcccaaatgaatatatttttccaatcatggtttgcaaaatcatgtttgcaaacttactttgaagactatttcctgattgccacggcagataattcgtggcaaatcagaaataatatttagtgagattaattattttgcacaatatatgttgttatagcaatatcaaaatcatttaaaacatcaatattgtattaatagaaaacatgtcaatatctcattaattccttttttattttatgttcctttttattttagaagcagtgttcatttttttctgaagtagaacgccagagcacagaacacacagttcaagtttaaattattaaattgtatgcaagaaattattgccatagcatagtcttgaggagaacacctctacagtatttcttgatctaagaacctgaacatatgttaatgaaattattagagtaagttctatctcaaaaatttcttattttatgaatgttttcttcacctaataaacaatactaaaatccataacagctgtctggcaacagtgtaattagagcttcttttatgttagagattccatctacctctgcatcttatctagctagatacagtctttctaaactttctcctttattcccatgtagagaacaaacaaaaatcacacctaaattaaagatctgtggtgaaggggaagaggggttgctattaggagttttcccggtaaaactgtaaaaacagtaatctgcattcagtatttgtttgcctagttcatcaagatatttaccctaaaaacacattttaataaaaatttgggtaaactcatgtatcgcagtaaaatcttttatgaattgggtgggccctaaaaacatctgtagtacgtgatgtgtttggttagattcagccaaaccgacacccgtatgctaagactgcattgtcattctgacaggaggcaggcctcagtagttgcagtgagtgcatttactaatataaggatccttctttgtagtgacaacaaaaatgagattgtaacttaatcaaatatgagtcagatatagtaattcctgatattgcagatgaaagagcagggtcttttcaagtgcttgctacaactgactaaatttgaagctttttatgtaaaagttcttctcccagatattttaaaccagtatgttaattatttcctagaatgaataattctccttttttgatagatttttgaaattgttttacttactacttacatactttgaacaaatatgtttttctaatcccagcattaaattgaaacaaatatttaaaataagattgttggaataaaagttatagatagtcacttgttgctaataaaagacattccttggcaacagccacatccagctaacttttgcaagaattttttaagggattagatttaggggttaatgtttagaattatttttaaaatataaattatattttaggctgtatttttgtgatttttaagtgaaaaaaataaaatgtagttgtcttgtttattctatagatatcttaatgaccactgaacaaatgatcatattgccacatggtctatcaactatggttactatgatagtgaaataaagaggatagttttgcttgacacctaaatgatccaaacagttgtttttacatgacttaaatcatggctgtattatttcatttttaaagaaaataaagtataaaataatacatttaaaatacctgtcaaagttttaaaatataagatagaaccttctttttttgccttcttacacatgaatgtacttaaagtattgttatgtgatcttgggatacttatttatttttgaaatttttgtatatatagcatttctgaacttagcaaataatatgtgtaaaggaattaaccaaaaatgaaagaactggcattttcatatggatacatattttgcttaaactaaataaaataacttagatttatttaaatcaggaatattttacgttgttgatcatttttaaagtatattttgttcaaatattcctaatttgtttttcagcacacttgtttaagttcttgcctttcaggtatactacagcgttatatgaacataatgttttaaaaaaatcttggttgtagtttctaattttcactgcataacaaatttgaaaccaaatgttgaatttctctgtgagggtacttattttgcctacagtttcaaatatattttcaaattcatctctttcttactagactgtgagctccttgtggacaaggatgttattttagttataatgacaactttaatatctagcaaagtgccaggcatagagtattcctttattgaaatgaattgatagatattgattattaaaatgctactacagtattctacgatgcaggctgaatgtatattacagtaattctctggctaattttaaaagtaagacatagaaaacaaaacacctgtagcattttctttatttaaaattgaaactctgttttgaatcctttttattttgtcaaacattctatgcaaatattgaaatatgcaacagctaaactttatggtacatattaattagttttattttcttttcaaaatcagaaatgctgtatttaagcttcctggaaatgtcgacaatcattttaatgaccaaaggtgctacttatttttcaacattgaccttgatcataagtgcttctatctgctgagctttatttattgtttttggacagaaagtttggtgggaaggttgcaataaaatcagaatctctcttgtctgaattatgcagtttaaccctgtccatgttcctctgtactctattcttactgtattttagttattgtttcttacttatcactaatttttactgcaggtctgtgctgtttcttagaaagtacatgcatatatatttctataatatgtaagaaaaaacctgtattgcttattaaattaaaattaaaataaaaaaattcatgttaaatttttgaaatgaaa

SEQ ID NO: 182985 - DNA, 1603 bp, Homo sapiens
  Payload ID: 16046
  Gene Symbol: SLC16A7
  Gene Name: solute carrier family 16 (monocarboxylate transporter), member 7
  ENST ID: ENST00000548610
  CDS Start-End: 298-1603
accttctttgacccatgatataatttaagccaagcttactttagactctgaaaagtatgaactaatagtgcacgtcaaagcaggttcttgaaaaagagaaataactaactttgccctatttgagagaagagagaggggagggcaaagcagagtctctggagatatgtatgtaagtttgcttgtggctaaaagttaatgatcagttgcctctcttcttagccctgagcctggagaaaagtgtcaaacgcaggttctctctctattcaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaa

SEQ ID NO: 182986 - DNA, 1878 bp, Homo sapiens
  Payload ID: 16046
  Gene Symbol: SLC16A7
  Gene Name: solute carrier family 16 (monocarboxylate transporter), member 7
  ENST ID: ENST00000549033
  CDS Start-End: 149-574
aaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtagaatatttgaaagctttttgatcttcacatccttgaggattcagtgcagctttactcaatcaggatcatgcctagctgccgtacataatgactcctctgatgaatctgggaaaaggagatggaaaatcttctggaaaggatttgctattctagataacatcacgatcattcactgttatgggaggaggtcaaaataccaacattaacagaagtttggaagaagtttatttcaatcctcatgggtgactttaagaggctcaggacttcagtgaagtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctg

SEQ ID NO: 182987 - DNA, 537 bp, Homo sapiens
  Payload ID: 16046
  Gene Symbol: SLC16A7
  Gene Name: solute carrier family 16 (monocarboxylate transporter), member 7
  ENST ID: ENST00000549465
  CDS Start-End: 205-441
cagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggttggtatcatatgcaatagctgtatattccatcagttgattgacgtgttattatgggatcgctgtctaaagaacacaattggaaagataataaatttgttccagtttggaatctt

SEQ ID NO: 182988 - DNA, 797 bp, Homo sapiens
  Payload ID: 16046
  Gene Symbol: SLC16A7
  Gene Name: solute carrier family 16 (monocarboxylate transporter), member 7
  ENST ID: ENST00000548444
  CDS Start-End: 403-797
agtcagcagccatcaacatcaaaacaggaccctccaccagcaaaaagactgaaaatcactgaaggctgagatgatcattaacattttttagcaataaaatatttttaattgttatgcacactttttagatataattcaatgcacacttaatatagtgtgtaaagtgtaaacgtaacttttatatgcactgagaaaccaaaaaatttgtgactcactttattgcaatattcactttatcaaggttctctggaacctcacctgcagtgtctctgaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatt

SEQ ID NO: 182989 - DNA, 1969 bp, Homo sapiens
  Payload ID: 16046
  Gene Symbol: SLC16A7
  Gene Name: solute carrier family 16 (monocarboxylate transporter), member 7
  Uniprot ID: O60669
  ENST ID: ENST00000547379
  CDS Start-End: 223-1659
attccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatgga

SEQ ID NO: 182990 - DNA, 1815 bp, Homo sapiens
  Payload ID: 16046
  Gene Symbol: SLC16A7
  Gene Name: solute carrier family 16 (monocarboxylate transporter), member 7
  Uniprot ID: O60669
  ENST ID: ENST00000552024
  CDS Start-End: 373-1809
agcggatgctgcatcgcggcgcccttctccacccccttttctcctctacttccgcgaaaaggattgcagactgccttggaaagggcggtcgtgcccagtgccactttcccggagtcaatcttaagatgtgatactttcctgtgaaacctgaaacaaggtgatctggggaaccaaagactctgggactcttggtgccaacagagttactctataatccaaaatctactctacatcttttcctttgtattgccttcaaatatcactcttcaaagtttagtgactaggcttaaagattccacatataatccaaagaaatctgttcaagtggacatctatcaacacgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaa

SEQ ID NO: 182991 - DNA, 544 bp, Homo sapiens
  Payload ID: 16046
  Gene Symbol: SLC16A7
  Gene Name: solute carrier family 16 (monocarboxylate transporter), member 7
  ENST ID: ENST00000549305
  CDS Start-End: 131-385
caaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggagcaggtcccaagctcccatctcacctccaggaagaatgaagcacatggacaaccggagagcgagcaaggcagagaggagcttcactgagcaacaaaacaactcttaggagagccacggaaaaaaggagaagcggaatgcatcattcaccctttaaagagatcaccatctacttgaggtagaatatttgaaagcttttt

SEQ ID NO: 182992 - DNA, 1715 bp, Homo sapiens
  Payload ID: 16046
  Gene Symbol: SLC16A7
  Gene Name: solute carrier family 16 (monocarboxylate transporter), member 7
  ENST ID: ENST00000549928
  CDS Start-End: 132-386
acaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggaaaaaaggagaagcggaatgcatcattcaccctttaaagagatcaccatctacttgaggtagaatatttgaaagctttttgatcttcacatccttgaggattcagtgcagctttactcaatcaggatcatgcctaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcac

SEQ ID NO: 182993 - DNA, 605 bp, Homo sapiens
  Payload ID: 16046
  Gene Symbol: SLC16A7
  Gene Name: solute carrier family 16 (monocarboxylate transporter), member 7
  ENST ID: ENST00000546459
  CDS Start-End: 154-408
attctaaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggaaaaaaggagaagcggaatgcatcattcaccctttaaagagatcaccatctacttgaggtagaatatttgaaagctttttgatcttcacatccttgaggattcagtgcagctttactcaatcaggatcatgcctagctgccgtacataatgactcctctgatgaatctgggaaaaggagatggaaaatcttctggaaaggatttgctattctagataacatcacgatcattcac

SEQ ID NO: 182994 - DNA, 2250 bp, Homo sapiens
  Payload ID: 16046
  Gene Symbol: SLC16A7
  Gene Name: solute carrier family 16 (monocarboxylate transporter), member 7
  Uniprot ID: O60669
  ENST ID: ENST00000552432
  CDS Start-End: 280-1716
tccccttcccgccaccgcctccttctccgctggctgtggcgggcgaggacacgtcaggggccataaataaataaataattccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaa

SEQ ID NO: 182995 - DNA, 505 bp, Homo sapiens
  Payload ID: 16046
  Gene Symbol: SLC16A7
  Gene Name: solute carrier family 16 (monocarboxylate transporter), member 7
  ENST ID: ENST00000551877
  CDS Start-End: 140-391
aatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcccaagctcccatctcacctccaggaagaatgaagcacatggacaaccggagagcgagcaaggcagagaggagcttcactgagcaacaaaacaactcttaggagagccacgactacccagaactgacagtctgacccccaggcctca

SEQ ID NO: 182996 - DNA, 571 bp, Homo sapiens
  Payload ID: 16046
  Gene Symbol: SLC16A7
  Gene Name: solute carrier family 16 (monocarboxylate transporter), member 7
  ENST ID: ENST00000550062
  CDS Start-End: 77-370
aggattctaaaaagagcaatggttcacaaggaaacttctgcctcaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggaagaatgaagcacatggacaaccggagagcgagcaaggcagagaggagcttcactgagcaacaaaacaactcttaggagagccacgactacccagaactgacagtctgacccccaggcctcaggctgtctctggattaaaggtggggtttcaccaaggatccacccctttctgcccaggaatctgtctgcctcccaccatcaacatgccctccatggcacccaggaaaaaaggagaagcggaatgcatcattcaccctttaaagagatcaccatcta

SEQ ID NO: 182997 - DNA, 1878 bp, Homo sapiens
  Payload ID: 16047
  Gene Symbol: SLC16A8
  Gene Name: solute carrier family 16 (monocarboxylate transporter), member 8
  Uniprot ID: O95907
  ENST ID: ENST00000320521
  CDS Start-End: 110-1624
cagttgtccttcagagggagcctgcagaggtgcagagtcaggtgggacccgtcgtcctcccctcgtccttcagcgccctttgcaggagaaggagacttgggaggcagcgatgggcgctggcggcccccggcggggcgagggccccccagacggcggctggggctgggtggtgctgggcgcctgctttgtggtcaccggcttcgcctacggcttccccaaagccgtgagcgtcttcttccgcgcgctcatgcgcgacttcgacgccggctacagcgacacggcctgggtgtcctccatcatgctagccatgctctacggcacgggccccgtgtccagcatcctcgtgacccgctttggctgtcgcccggtgatgctggcgggtgggctgctggcttccgcgggcatgatcctagcttcctttgccacgcgcctcctggagctctacctgaccgctggggtgctcacaggcctgggcctggccctcaacttccagccgtcgctcatcatgctggggctgtacttcgagcggcggcggcctctggccaacgggctggcggcggcgggcagccccgtgttcctgtccgcgctgtcgccgctcggccagcagctgctggagcgcttcggctggcgcggcggcttcctgctgctcggcgggctcctgctgcactgctgcgcctgcggggctgtcatgaggccgccgcccgggccgggcccgcgaccgcgcagggacagcgccggcgaccgcgccggggacgctccgggcgaggcggaggctgacggtgcggggctgcagctgcgcgaggcatcccccagggtccggccccgccggcgcctgctggacttggcagtgtgcaccgaccgcgccttcgccgtgtacgccgtcaccaagttcctgatggcgctcgggctcttcgtccccgccatcctgctggtgaactacgccaaggacgcgggcgtgcccgacaccgacgccgccttcctgctgtccatcgtgggcttcgtggacatcgtggcgcgcccggcgtgcggcgccctggcgggcctggcgcgtctgcggccgcacgtcccgtatctgttcagcctggccctgctggccaatgggctcacagacctgagcagcgcacgcgcgcgctcctacggcgccctcgtcgccttctgcgtcgccttcggcctctcctacggcatggtgggcgcgctgcagttcgaggtgctcatggcggctgtgggcgcgccccgcttccccagtgcgctgggcctggtgttgctcgtggaggccgcggctgtgctcatcggaccgccctctgccggccgcctggtggatgtgttgaagaactatgagatcatcttctacctggccggctctgaggtggccctggctggggtcttcatggctgtcgccaccaactgctgcctgcgttgtgctaaagctgccccgtcaggcccaggcactgagggcggagccagtgacactgaggacgctgaggctgaaggggactctgagcccctgcctgttgttgcagaggaacccggcaacctggaggccctggaggtgctcagcgcccggggcgagcccacagaaccagaaatagaggcgaggccgaggctggctgccgagtctgtataactcagggtgctctgggtggggtggcccagtgacttgggaacacagcttcttgtctcagagagcctggtacgctgggaggctggtctggggtggtcactcccggggtccacgtctgggctccagttgatcccctgggtgtctgggaactgcctccctcatctgtgccccaagttccgccaggccctgccccatcgccagtgaagctgctatggagcaacaggaaactggtgataaagctcagctgaacgacagaa

SEQ ID NO: 182998 - DNA, 726 bp, Homo sapiens
  Payload ID: 16047
  Gene Symbol: SLC16A8
  Gene Name: solute carrier family 16 (monocarboxylate transporter), member 8
  ENST ID: ENST00000427592
  CDS Start-End: 435-726
gcagcccccatccgggtaagcttcaccgggagctgcggcggcggcccctccctgcaggcctcaggagatgtgaggctggacccccaaacccacgaggcaggctcagtcatttgtgatcactgagaaacattaggaacatggcggaaggctaaagaggaaaatcacgcacagcggccctttgcagccggcatctgcccctctgctgtttgttctgttgtcccgagaccctcacgcgtacggggcgactttggtgctggacgcccacctccaggcacatacctgctccacttcccgacgccttccacctgaggccctgaggggccagcagttgtccttcagagggagcctgcagaggtgcagagtcaggtgggacccgtcgtcctcccctcgtccttcagcgccctttgcaggagaaggagacttgggaggcagcgatgggcgctggcggcccccggcggggcgagggccccccagacggcggctggggctgggtggtgctgggcgcctgctttgtggtcaccggcttcgcctacggcttccccaaagccgtgagcgtcttcttccgcgcgctcatgcgcgacttcgacgccggctacagcgacacggcctgggtgtcctccatcatgctagccatgctctacggcacgggccccgtgtccagcatcctcgtgacccgctttggctgtcgcccggtgatgctggcgggtgggctgctggcttccgcgg

SEQ ID NO: 182999 - DNA, 1803 bp, Homo sapiens
  Payload ID: 16048
  Gene Symbol: SLC16A11
  Gene Name: solute carrier family 16, member 11
  Uniprot ID: Q8NCK7
  ENST ID: ENST00000308009
  CDS Start-End: 339-1754
atctctgtttaccgagagagcccgtccaagttgggctccatcgctgccctcgctccccttcggggcccccgcccgcctgggaagcagagagaaagccgggcccagcccttcctcacccttcccctccccgcaccgcccggagaggtcgggtaagggggaaggagtgtgcgtgggacggggaacctcgggcctggggatctggctgtccccgtccccgtacctcgcgcggacccgggagttccagccctaggccaggctccggctccctccgccccgcgccatcgcgctcggagtgacgggcccaccccgggcgagcagccagaggctggatctcagggatgccagctccccagcggaagcacaggcgtggaggcttctctcacagatgtttccccaccccgcagacggcgatgaccccccagcccgccggacccccggatgggggctggggctgggtggtggcggccgcagccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctcgctggctttggttgggccctggtgttcgcccccgccctaggcaccctctcgcgttacttctcccgccgtcgagtcttggcggtggggctggcgctcaccggcaacggggcctcctcgctgctcctggcgcccgccttgcagcttcttctcgatactttcggctggcggggcgctctgctcctcctcggcgcgatcaccctccacctcaccccctgtggcgccctgctgctacccctggtccttcctggagaccccccagccccaccgcgtagtcccctagctgccctcggcctgagtctgttcacacgccgggccttctcaatctttgctctaggcacagccctggttgggggcgggtacttcgttccttacgtgcacttggctccccacgctttagaccggggcctggggggatacggagcagcgctggtggtggccgtggctgcgatgggggatgcgggcgcccggctggtctgcgggtggctggcagaccaaggctgggtgcccctcccgcggctgctggccgtattcggggctctgactgggctggggctgtgggtggtggggctggtgcccgtggtgggcggcgaagagagctgggggggtcccctgctggccgcggctgtggcctatgggctgagcgcggggagttacgccccgctggttttcggtgtactccccgggctggtgggcgtcggaggtgtggtgcaggccacagggctggtgatgatgctgatgagcctcggggggctcctgggccctcccctgtcaggcttcctaagggatgagacaggagacttcaccgcctctttcctcctgtctggttctttgatcctctccggcagcttcatctacatagggttgcccagggcgctgccctcctgtggtccagcctcccctccagccacgcctcccccagagacgggggagctgcttcccgctccccaggcagtcttgctgtccccaggaggccctggctccactctggacaccacttgttgattattttcttgtttgagcccctcccccaataaagaatttttatcgggtt

SEQ ID NO: 183000 - DNA, 1779 bp, Homo sapiens
  Payload ID: 16048
  Gene Symbol: SLC16A11
  Gene Name: solute carrier family 16, member 11
  ENST ID: ENST00000447225
  CDS Start-End: 411-1730
atctctgtttaccgagagagcccgtccaagttgggctccatcgctgccctcgctccccttcggggcccccgcccgcctgggaagcagagagaaagccgggcccagcccttcctcacccttcccctccccgcaccgcccggagaggtcgggtaagggggaaggagtgtgcgtgggacggggaacctcgggcctggggatctggctgtccccgtccccgtacctcgcgcggacccgggagttccagccctaggccaggctccggctccctccgccccgcgccatcgcgctcggagtgacgggcccaccccgggcgagcagccagaggctggatctcagggatgccagctccccagcggaagcacaggcgtggaggcttctctcacagatgtttccccaccccgcagacggcgatgaccccccagcccgccggacccccggatgggggctggggctgggtggtggcggccgcagccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctcgctggctttggttgggccctggtgttcgcccccgccctaggcaccctctcgcgttacttctcccgccgtcgagtcttggcggtggggctggcgctcaccggcaacggggcctcctcgctgctcctggcgcccgccttgcagcttcttctcgatactttcggctggcggggcgctctgctcctcctcggcgcgatcaccctccacctcaccccctgtggcgccctgctgctacccctggtccttcctggagaccccccagccccaccgcgtagtcccctagctgccctcggcctgagtctgttcacacgccgggccttctcaatctttgctctaggcacagccctggttgggggcgggtacttcgttccttacgtgcacttggctccccacgctttagaccggggcctggggggatacggagcagcgctggtggtggccgtggctgcgatgggggatgcgggcgcccggctggtctgcgggtggctggcagaccaaggctgggtgcccctcccgcggctgctggccgtattcggggctctgactgggctggggctgtgggtggtggggctgagctgggggggtcccctgctggccgcggctgtggcctatgggctgagcgcggggagttacgccccgctggttttcggtgtactccccgggctggtgggcgtcggaggtgtggtgcaggccacagggctggtgatgatgctgatgagcctcggggggctcctgggccctcccctgtcaggcttcctaagggatgagacaggagacttcaccgcctctttcctcctgtctggttctttgatcctctccggcagcttcatctacatagggttgcccagggcgctgccctcctgtggtccagcctcccctccagccacgcctcccccagagacgggggagctgcttcccgctccccaggcagtcttgctgtccccaggaggccctggctccactctggacaccacttgttgattattttcttgtttgagcccctcccccaataaagaatttttatcgggtt

SEQ ID NO: 183001 - DNA, 430 bp, Homo sapiens
  Payload ID: 16048
  Gene Symbol: SLC16A11
  Gene Name: solute carrier family 16, member 11
  ENST ID: ENST00000574600
  CDS Start-End: 150-430
gtttaccgagagagcccgtccaagttgggctccatcgctgccctcgctccccttcggggcccccgcccgcctgggaagcagagagaaagccgggcccagcccttcctcacccttcccctccccgcaccgcccggagaggtcggacggcgatgaccccccagcccgccggacccccggatgggggctggggctgggtggtggcggccgcagccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctggg

SEQ ID NO: 183002 - DNA, 4617 bp, Homo sapiens
  Payload ID: 16049
  Gene Symbol: SLC16A12
  Gene Name: solute carrier family 16, member 12
  ENST ID: ENST00000371790
  CDS Start-End: 302-1852
tcagtctcgccggcggcccccgctcccggatccccagcgccctggccaagaagcttcctcggctccccctcttccctctccctgacacggttgtgcagagggcgcggtggctcagatacaggatttcgacatattggccggtttgctctcgagctcctgggctcaagcgatctgcccgctttagcctcccaaagtgatgggattacaggcgtgagccaccgtgcctggccataatttttaaaaatgtctagtcagatggcgagtaacccatgggccaggtagcgttctatgccaaccttgaatgccatcaggaagtcactggacagcaaactcttccaagatcataacttggctgttggagcaacctggaaaagaagaaaaaagaaaaaccatggcaaaagtaaatagagctcggtctacctcccctccagatggaggctggggctggatgattgtggctggctgtttccttgttaccatctgcacacgggcagtcacaagatgtatctcaattttttttgtggagttccagacatacttcactcaggattacgcacaaacggcatggatccattccattgtagattgtgtgaccatgctctgtgctccacttgggagtgttgtcagtaaccatttatcctgtcaagtgggaatcatgctgggtggcttgcttgcatctactggactcatcctgagctcatttgccacgagtctgaagcatctctacctcactctgggagttcttacaggtcttggatttgcactttgttactctccagctattgccatggttggcaagtacttcagcagacggaaagcccttgcttatggtatcgccatgtcaggaagtggcattggcaccttcatcctggctcctgtggttcagctccttattgaacagttttcctggcggggagccttactcattcttgggggctttgtcttgaatctctgtgtatgtggtgccttgatgaggccaattactcttaaagaggaccacacaactccagagcagaaccatgtgtgtagaactcagaaagaagacattaagcgggtgtctccctattcatctttgaccaaagaatgggcacagacttgcctctgttgctgtttgcagcaagagtacagttttttactcatgtcagactttgttgtgttagccgtctccgttctgtttatggcttatggctgcagccctctctttgtgtacttggtgccttatgctttgagtgttggagtgagtcatcagcaagctgcttttcttatgtccatacttggagtgattgacattattggcaatatcacatttggatggctgaccgacagaaggtgtctgaagaattaccagtatgtttgctacctctttgccgtgggaatggatgggctctgctatctctgcctcccaatgcttcaaagtctccctctgctcgtgcctttctcttgtacctttggctactttgatggtgcctatgtgactttgatcccagtagtgaccacagagatagtggggaccacctctttgtcatcagcgcttggtgtggtatacttccttcacgcagtgccatacttggtgagcccacccatcgcaggacggctggtagataccaccggcagctacactgcagcattcctcctctgtggattttcaatgatatttagttctgtgttgcttggctttgctagacttataaagagaatgagaaaaacccagttgcagttcattgccaaagaatctgatcctaagctgcagctatggaccaatggatcagtggcttattctgtggcaagagaattagatcagaaacatggggagcctgtggctacagcagtgcctggctacagcctcacatgaccaaaggccttgagccccagaatcttcaggtttgagagaggtggggccaccagattcttcatgtttctgaaactttttattttggcagaaggattgccttccaaggaaattattattattgttttgttaacatattaatatttataagggaaaacagcacataataaggaaagctggactagcccagagccttctcatttgggatttgtgctcataactgaactcgtatcttttggtcaatgggcatagctctgtaagaaatgtaaggacacagctgatataattagctgtaattagggataatttcaaagcataaccaaagcagatgacactgggcagcagctttgttccagtctcaggcccttcatgttccctcctcagaaagaaaatggaaacattaacgtgtagctttgcttaccttgttctggttagagaagggaggtcagcttgggtgtggtggtgaagagtgaagatgccatactttttcatggtggagtttctcattagggttttacttgggattgttaaagaatacttgagattcttcaaaaagtggtgattaatatagaaagaaactcttattttttttttctcttagtcttccagccagcccttgcctctgcccaagggtagacaccactatgagaatccaaataatcatggaatgccatggttggaatagatcttaaagggcatctggtaagatccatttgaaattgtccactggaaaccgaaagctcttttcctaagactgggttccaggctctcacatttgttaccatcacatataatacttactctaaatttagcagaacacacttagtcacaaggacaacctctcaatcttacctgaaatgtcaacaacaccaaaacttcccgtcttttaccttcagagaagaagctcttacttagactgcagacgcattcctgttaggttggaaaaatgttggcagtattccaattgggcaggaactgaattcttgaatcagcaggtctctggtgagagttttctttgcagatcagacatttagttttatcattacccaaaagaggattggagggagtcagttgtctgaaaaatattatcctagagatattctaaaggtgagattcctttctccctgtgttaattcttgttccactatccactgctcttcatctctttatagataataattagaaatctactcattggattataagtttattcattctcaaatactccacttttctatggtttgggataatttctgagtcttcagattgaagagggaaggcatggagggaagaaaaagtccagatcccccagcttgtttccaaccattttaagtccaaagaattataatcctgaatctcacagtgtgtcacacctgtaataggagtaaattatgcaatcaattttaattaccaggagtttaaaatccaaatgtcaaggaactgttttgaccctgaaggctatttaatccactgtcccctacaaggcctcacaagtgctgggggaaaaaaaacagcaatgaggatgatcctgagttaatgtgtatgctccgcaagagagcttgcctataccttgattatttcataaaatcacatgttaatacattgctttcagaatgaaatactgacttgatctgataggagaaaatggtaatatttcatagttgttttccaaagacaaatttaaatgttgtctgttatctccttacttagtttaagaatttagttttgaaccccattgactttgtcatttgcaattttaaaaatatttgggactgggcatggtcgctcacgcctgtaatcccagcactttgggaggctgaggcgggtggatcatgaggtcaggagatcaagaccatcctggctaacatcgtgaaactccgtctctactaaaaatgcaaaaaattagccaggcgtggtggcgggcgcctgtagtcccagctactcatgaggctgaggccggacaatcgcttgaacccaggaggtggaggttgcagtgagccaaaatcatgccactgcactccaccctgggcgacagagcaagactccatctcaaaaaaaaaaaattggaaggtatctgtaaaatgtcaaagttaagatgaagttatatctgtttggaatagcactttgccctaaatatcatttcttgaattttcaagcctaaagatgtttaaaaatatgaatagttacaaatattcttatacatattttttatcatgatcacaacaaaattttgtttatgtggttctgcaatataatttctgtgaagtattacaagtatttatgaaaaataagcatagtgatcagaaattttaaagattttgtataaaaacatttgggagatttgactttatacatgcatagatttgcattttactttcccttttgaggcagcatttttagaaaatcagtaagaaaaatgtacatcttaaggtctactattttacatttctacacagaattttagtgttaatgttccatgtgtctatactgtttatttcaaaactgagaaattcatgggaatgatgtattttgtggaatcaagaacaaaattatagtgggataattttacatcttaaatatttctttctactactgtaagctctactttggaattatctgagtagaaaatcagaagacattatctaactttgtagatacactgtatgattgggctttttgttcagattgtaatttcattaatagatgaaatatttatgctaatattttcttatttcaaaagcaaaataaaatgaatttattgtcctgtg

SEQ ID NO: 183003 - DNA, 340 bp, Homo sapiens
  Payload ID: 16049
  Gene Symbol: SLC16A12
  Gene Name: solute carrier family 16, member 12
  ENST ID: ENST00000475682
  CDS Start-End: 265-340
gaaatggaggtgttctgacctatgatcagacaaggtaggtcagaaaccagctccagaaaccaggaaaaagttcctgccttggggagagaaagaaataggtgaaaggagggcagaaaaggagccctgcctgttttgctcgttgttgcctcactagcccataccagagtgcagggtgcgctgtaagccgtgaccgcatcacagatcatcagcatgcagagatggcgagtaacccatgggccaggtagcgttctatgccaaccttgaatgccatcaggaagtcactggacagcaaactcttccaagatcataacttggctgttggagcaacctggaaaagaag

SEQ ID NO: 183004 - DNA, 1748 bp, Homo sapiens
  Payload ID: 16050
  Gene Symbol: SLC16A13
  Gene Name: solute carrier family 16, member 13
  Uniprot ID: Q7RTY0
  ENST ID: ENST00000308027
  CDS Start-End: 309-1589
agccgaacaccgaaccgggaccgatccggccccggcttgaactagctcagctccgagctcgcggaaccacgcccccgggagactctggcccggccagcgcgggccaggtcttcagtcctatatcgccccgccttgggaaaaggtgcaggggcctctcgccgcctcgtcgggcccttcctctctacctgcctctccaacccctctcggccccgagccacccggcagcgggggtgggtgtgcagaggtgcggcgtccagaacccggctcctgcagaggctctgggtggcagcagccctgttaccgcttagatggcgcgcaggacagagccccccgacgggggctggggatgggtggtggtgctctcagcgttcttccagtcggcgcttgtgtttggggtgctccgctcctttggggtcttcttcgtggagtttgtggcggcgtttgaggagcaggcagcgcgcgtctcctggatcgcctccataggaatcgcggtgcagcagtttgggagcccggtaggcagtgccctgagcacgaagttcgggcccaggcccgtggtgatgactggaggcatcttggctgcgctggggatgctgctcgcctcttttgctacttccttgacccacctatacctgagtattgggttgctgtcaggctctggctgggctttgaccttcgctccgaccctggcctgcctgtcctgttatttctctcgccgacgatccctggccaccgggctggcactgacaggcgtgggcctctcctccttcacatttgccccctttttccagtggctgctcagccactacgcctggagggggtccctgctgctggtgtctgccctctccctccacctagtggcctgtggtgctctcctccgcccaccctccctggctgaggaccctgctgtgggtggtcccagggcccaactcacctctctcctccatcatggccccttcctccgttacactgttgccctcaccctgatcaacactggctacttcattccctacctccacctggtggcccatctccaggacctggattgggacccactacctgctgccttcctactctcagttgttgctatttctgacctcgtggggcgtgtggtctccggatggctgggagatgcagtcccagggcctgtgacacgactcctgatgctctggaccaccttgactggggtgtcactagccctgttccctgtagctcaggctcccacagccctggtggctctggctgtggcctacggcttcacatcaggggctctggccccactggccttctccgtgctgcctgaactaatagggactagaaggatttactgtggcctgggactgttgcagatgatagagagcatcggggggctgctggggcctcctctctcaggctacctccgggatgtgacaggcaactacacggcttcttttgtggtggctggggccttccttctttcagggagtggcattctcctcaccctgccccacttcttctgcttctcaactactacctccgggccccaggaccttgtaacagaagcactagatactaaagttcccctacccaaggaggggctggaagaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaaccctttgta

SEQ ID NO: 183005 - DNA, 4398 bp, Homo sapiens
  Payload ID: 16051
  Gene Symbol: SLC16A14
  Gene Name: solute carrier family 16, member 14
  Uniprot ID: Q7RTX9
  ENST ID: ENST00000295190
  CDS Start-End: 460-1992
agccaaagctataaacttcaaccggccacaagagtgtgcatgtgaggtgactgcattttttttccctgccaaaccagaattagccggtataggaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgactagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagtgataacaaatagcccatctctagactctcgtgttgttatatagaccattcatttgcctgagcgtggcacagttttaaaaatagttctcttgattgatttcatacagaagatgactgtgatccatgacatctaataatgccctttctttatctgagatgtctatttttctaagccaaacgtttttcagactgcagaatgttcttcccagatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctctttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcgggaattgcctgtaaattattatagacaatagattgcatgtcatactccatttggttcaacacaacaacctatgtgttatcattacagctttggctgctgttaaagaatccagctctctattttgataaagataatcttaaagctgaggcaatgctccctcctctatctctctctgtgtaatttaccatagaattaggatgattagattgaaacacatgttgtatgttttaaaaactacattgcttcattactttcattttccgacaacatcaaactaacaagaggcagtgttaaatattttaaatggtgctatagccaatgtatttgaatgcttgcactgctggttgtgtatcatcaatatgaactttttatccaatgactcaactctaattacatctaagttagacttgctcacgttcagtttgtacagttgtgtgttgacttactatgttttgaaagtggtgacttctaccgaatgagtggaagttcccattgtcaaaaaaaataaagacctgcttgcagtattcatgttgacaacagagtaaaagagaatactgtaaagaattactgcaaatatttcctgtttatgttatttgccgttgtttgaagatattataaagggttaattgtatatttatatcatgtgctttatcgttttcccctcatgtatccaagtaatttttatttacatacaactaaataaatgttgtcctctttgaagacggtca

SEQ ID NO: 183006 - DNA, 537 bp, Homo sapiens
  Payload ID: 16051
  Gene Symbol: SLC16A14
  Gene Name: solute carrier family 16, member 14
  ENST ID: ENST00000425822
  CDS Start-End: 412-537
gcttggggacgcgcgccttgctgctcaagctggccggggccccgcgagcgtcatcctgggcacccccgtccggctggagaagcgcgttctgcccggagcccagcctcgctgcccggctgctctctaggcccgtttgggactcgaactggacagtgatgaggcgcagagcgggggacccggggctgcgcctagggacttcgcggggtgcggatgcctctctgcacaggctgtggtgctgcagccggcccagcttccccgctcagctcagctccgctccccagccttctccgcggcagcctcttcagcctgctggccgcaagtgcgccctctaaaggccccaaatgccctgtacacaccaggtgaagagcgcggaagcgcctgcagagcagaattaaagaaaaatcttggaaaatgtataccagtcatgaagatattgggtatgattttgaagatggccccaaagacaaaaagacactgaagccccacccaaacattgatggcggatgggcttggatgatggtgctctcctctttcttt

SEQ ID NO: 183007 - DNA, 1672 bp, Homo sapiens
  Payload ID: 16051
  Gene Symbol: SLC16A14
  Gene Name: solute carrier family 16, member 14
  ENST ID: ENST00000412034
  CDS Start-End: 217-1672
atccgaggccgcgcgcgccgcgggcctggggaatggagcgacgccgggggcatcggagcctagctcagctcagctccgctccccagccttctccgcggcagcctcttcagcctgctggccgcaagtgcgccctctaaaggccccaaatgccctgtacacaccaggtgaagagcgcggaagcgcctgcagagcagaattaaagaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcaggtaaactctctgaggttttaagagctcagagtgcatgtacatatggtgcgttatgttataaagtcccagataaag

SEQ ID NO: 183008 - DNA, 646 bp, Homo sapiens
  Payload ID: 16051
  Gene Symbol: SLC16A14
  Gene Name: solute carrier family 16, member 14
  ENST ID: ENST00000436869
  CDS Start-End: 593-646
agctataaacttcaaccggccacaagagtgtgcatgtgaggtgactgcattttttttccctgccaaaccagaattagccggtataggaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgctcagctcagctccgctccccagccttctccgcggcagcctcttcagcctgctggccgcaagtgcgccctctaaaggccccaaatgccctgtacacaccaggtgaagagcgcggaagcgcctgcagagcagaattaaagaaaaatcttggaaaatgtataccagtcatgaagatattgggtatgattttgaagatggccccaaagac

SEQ ID NO: 183009 - DNA, 1836 bp, Homo sapiens
  Payload ID: 16051
  Gene Symbol: SLC16A14
  Gene Name: solute carrier family 16, member 14
  ENST ID: ENST00000457406
  CDS Start-End: 368-1836
gaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcaggtaaactctctgaggttttaagagctcagagtgcatgtacatatggtgcgttatgttataaagtcccagataaagaagaaggtttcca

SEQ ID NO: 183010 - DNA, 4161 bp, Homo sapiens
  Payload ID: 16052
  Gene Symbol: SLC16A2
  Gene Name: solute carrier family 16, member 2 (thyroid hormone transporter)
  Uniprot ID: P36021
  ENST ID: ENST00000587091
  CDS Start-End: 178-1797
ggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaatttg

SEQ ID NO: 183011 - DNA, 1886 bp, Homo sapiens
  Payload ID: 16052
  Gene Symbol: SLC16A2
  Gene Name: solute carrier family 16, member 2 (thyroid hormone transporter)
  ENST ID: ENST00000590447
  CDS Start-End: 1-688
cagctccttcaccagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctgatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcag

SEQ ID NO: 183012 - DNA, 2632 bp, Homo sapiens
  Payload ID: 16053
  Gene Symbol: SLC16A4
  Gene Name: solute carrier family 16, member 4
  Uniprot ID: O15374
  ENST ID: ENST00000369779
  CDS Start-End: 251-1714
acagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaaaaa

SEQ ID NO: 183013 - DNA, 2082 bp, Homo sapiens
  Payload ID: 16053
  Gene Symbol: SLC16A4
  Gene Name: solute carrier family 16, member 4
  Uniprot ID: O15374
  ENST ID: ENST00000369781
  CDS Start-End: 217-1176
cactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaa

SEQ ID NO: 183014 - DNA, 2372 bp, Homo sapiens
  Payload ID: 16053
  Gene Symbol: SLC16A4
  Gene Name: solute carrier family 16, member 4
  Uniprot ID: O15374
  ENST ID: ENST00000437429
  CDS Start-End: 304-1452
acagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcagaaatcattccttccttccaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 183015 - DNA, 1962 bp, Homo sapiens
  Payload ID: 16053
  Gene Symbol: SLC16A4
  Gene Name: solute carrier family 16, member 4
  ENST ID: ENST00000461647
  CDS Start-End: 230-403
aggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaa

SEQ ID NO: 183016 - DNA, 2420 bp, Homo sapiens
  Payload ID: 16053
  Gene Symbol: SLC16A4
  Gene Name: solute carrier family 16, member 4
  Uniprot ID: O15374
  ENST ID: ENST00000472422
  CDS Start-End: 195-1514
gtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaa

SEQ ID NO: 183017 - DNA, 1551 bp, Homo sapiens
  Payload ID: 16053
  Gene Symbol: SLC16A4
  Gene Name: solute carrier family 16, member 4
  ENST ID: ENST00000492412
  CDS Start-End: 217-390
cactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaaga

SEQ ID NO: 183018 - DNA, 1562 bp, Homo sapiens
  Payload ID: 16053
  Gene Symbol: SLC16A4
  Gene Name: solute carrier family 16, member 4
  ENST ID: ENST00000528649
  CDS Start-End: 216-344
actagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcagaaatcattccttccttccaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaattttttttttttttttttt

SEQ ID NO: 183019 - DNA, 1059 bp, Homo sapiens
  Payload ID: 16053
  Gene Symbol: SLC16A4
  Gene Name: solute carrier family 16, member 4
  ENST ID: ENST00000467986
  CDS Start-End: 1-660
gagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggtaacaccttcaccacattctgaacaaatttcaatagcaataaaagagaaaaactgatccaggattaatggtaacatgtaatgatggtatcaggttaaaagaaacagattatttctgcttttcctatatctactcactccaccaccaatgcaggaaaatctgaaggctcagattcttgtattatcttaagatgtgccttaagcagattcttatattcttgggagttgtagggcagacactggatctatgtctacttgtctggggagacaatccagagttttttcagagcctcaaagacccatgatgctttaaaaaaaaaaaaaaaaggctgggagcaattgctcacgcctgtaattctagcactctgggaggccaaggcgggggtatcacttgagctgaggggttcaagaccagcctgggca

SEQ ID NO: 183020 - DNA, 2496 bp, Homo sapiens
  Payload ID: 16053
  Gene Symbol: SLC16A4
  Gene Name: solute carrier family 16, member 4
  Uniprot ID: O15374
  ENST ID: ENST00000541986
  CDS Start-End: 304-1581
acagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaa

SEQ ID NO: 183021 - DNA, 3807 bp, Homo sapiens
  Payload ID: 16054
  Gene Symbol: SLC16A6
  Gene Name: solute carrier family 16, member 6
  Uniprot ID: O15403
  ENST ID: ENST00000327268
  CDS Start-End: 166-1737
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttcctttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagaga

SEQ ID NO: 183022 - DNA, 584 bp, Homo sapiens
  Payload ID: 16054
  Gene Symbol: SLC16A6
  Gene Name: solute carrier family 16, member 6
  ENST ID: ENST00000582867
  CDS Start-End: 330-584
cttttctcatgttaccgagcggcttataaggagggggaggccaagcctccgccttattgggagcctttgggggtttattctcttcccttctaacttggctggagcgcagcggcacaatctcagctcactgcaacctctgcctcctgggttcaagcagttctcccaccgcagcctcccgagtagctggaagcacagacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagc

SEQ ID NO: 183023 - DNA, 2659 bp, Homo sapiens
  Payload ID: 16054
  Gene Symbol: SLC16A6
  Gene Name: solute carrier family 16, member 6
  Uniprot ID: O15403
  ENST ID: ENST00000580666
  CDS Start-End: 189-1760
gtgggtggagggcccgggcgctcgggcctcaccagcccgagccaacttgcgctagagtcgggcccgccccctaaggggttaatccttttctcatgttaccgagcggcttataaggagggggaggccaagcctccgccttattgggagcctttgggggtttattctcttcccttctaacttgattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagc

SEQ ID NO: 183024 - DNA, 577 bp, Homo sapiens
  Payload ID: 16054
  Gene Symbol: SLC16A6
  Gene Name: solute carrier family 16, member 6
  ENST ID: ENST00000583477
  CDS Start-End: 190-577
agtgggtggagggcccgggcgctcgggcctcaccagcccgagccaacttgcgctagagtcgggcccgccccctaaggggttaatccttttctcatgttaccgagcggcttataaggagggggaggccaagcctccgccttattgggagcctttgggggtttattctcttcccttctaacttgattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcaggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattg

SEQ ID NO: 183025 - DNA, 2055 bp, Homo sapiens
  Payload ID: 16054
  Gene Symbol: SLC16A6
  Gene Name: solute carrier family 16, member 6
  ENST ID: ENST00000620436
  CDS Start-End: 13-1581
ttcagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaggatgatgtcgtgggcattgaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtc

SEQ ID NO: 183026 - DNA, 3646 bp, Homo sapiens
  Payload ID: 16055
  Gene Symbol: SLC16A9
  Gene Name: solute carrier family 16, member 9
  Uniprot ID: Q7RTY1
  ENST ID: ENST00000395347
  CDS Start-End: 110-1639
agtttgaggccaacactaggaagtgtctggaaccggatccggaggcttcacaatctatatgttgcctccaaaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgc

SEQ ID NO: 183027 - DNA, 4178 bp, Homo sapiens
  Payload ID: 16055
  Gene Symbol: SLC16A9
  Gene Name: solute carrier family 16, member 9
  Uniprot ID: Q7RTY1
  ENST ID: ENST00000395348
  CDS Start-End: 638-2167
gtgcgcaccgagagggcgcctggccgacggcgcccacctctctcgtggctttggtggctccaggcctggtagggccggggccgcggctcgggcagtgccctccctactcctggccgggccgggagcagcgggagcaggcgcagcgcccctaccgcccgcttttccgcctccatctcctccgcctcctcctcctccttcccccaaccacccgcgcagtcacaaccggttcagactggccggggtgccccgcaaagagagacaagggagaaaaagacagcagggaaaaccccggggaggagaaggcgaaagagaaggtggagctcagagaagggggccggctccccagctccatgtggccgccgccgctgcgggtctgtgggggcagagggcggcggctcccggggcagcgcgtagcgggaccgattgcctaatactccggcaggggccggggccgcagctggctcggataaatagccgcccggctggcccggagctgcaggggagagcggcggccgcgatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcatca

SEQ ID NO: 183028 - DNA, 3455 bp, Homo sapiens
  Payload ID: 16056
  Gene Symbol: SLC17A5
  Gene Name: solute carrier family 17 (acidic sugar transporter), member 5
  Uniprot ID: Q9NRA2
  ENST ID: ENST00000355773
  CDS Start-End: 270-1757
ggctcactttgcgccaatcctacgagaactcccagaactccgcttccctagtccaacccaagccagagttgcccacacctaagatggcggcgggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagagggtgttacatttccagccatgcatgccatgtggtcttcttgggctccccctcttgaaagaagcaaacttcttagcatttcatatgcaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagagaatgggtttttatcttcattgccttatttaggctcttggttatgtatgatcctgtctggtcaagctgctgacaatttaagggcaaaatggaatttttcaactttatgtgttcgcagaatttttagccttataggaatgattggacctgcagtattcctggtagctgctggcttcattggctgtgattattctttggccgttgctttcctaactatatcaacaacactgggaggcttttgctcttctggatttagcatcaaccatctggatattgctccttcgtatgctggtatcctcctgggcatcacaaatacatttgccactattccaggaatggttgggcccgtcattgctaaaagtctgacccctgataacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 183029 - DNA, 1844 bp, Homo sapiens
  Payload ID: 16057
  Gene Symbol: SLC17A1
  Gene Name: solute carrier family 17 (organic anion transporter), member 1
  Uniprot ID: Q14916
  ENST ID: ENST00000244527
  CDS Start-End: 117-1520
attgtgtaaagttgagagaaaagtcttcacagcggaagaagaaatcacttttttgtcccgaatcagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccactggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcaccagcaccaggaagaaggtggtaggaggagtcctaggggccagttttaccctcccacatatcctgtgtgcatcgttttttaacatgtgttgtttgtaacatgtaatatatctgaattttaaatgggggtggtgatttatctcagtcttcctctctgcatcagttgctttataaatgattgtcaaaccaataaatacacacaagataaaattttattctaaggcttcatgaaa

SEQ ID NO: 183030 - DNA, 1433 bp, Homo sapiens
  Payload ID: 16057
  Gene Symbol: SLC17A1
  Gene Name: solute carrier family 17 (organic anion transporter), member 1
  ENST ID: ENST00000377886
  CDS Start-End: 54-683
cagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtcagttcaagtagacaatctctgcctatcaaggctatacttaagtcgcttccagtctgggctatttccactggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcacca

SEQ ID NO: 183031 - DNA, 1242 bp, Homo sapiens
  Payload ID: 16057
  Gene Symbol: SLC17A1
  Gene Name: solute carrier family 17 (organic anion transporter), member 1
  Uniprot ID: Q14916
  ENST ID: ENST00000468082
  CDS Start-End: 1-1242
atgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctga

SEQ ID NO: 183032 - DNA, 1704 bp, Homo sapiens
  Payload ID: 16057
  Gene Symbol: SLC17A1
  Gene Name: solute carrier family 17 (organic anion transporter), member 1
  Uniprot ID: Q14916
  ENST ID: ENST00000476801
  CDS Start-End: 99-1502
aaaagtcttcacagcggaagaagaaatcacttttttgtcccgaatcagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccactggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaaggtgagaagtgatcagattaaggacaatttttgaaactgggaatgcaggagacagaggagataaggatgactcctcagacgagaaggaataacgggtgcaggtttggagaagaggagaccatgttaagcctgagaatattagacatcctgaaatggctgtgggactctgtggggatgctaaggctggagatataaatttgg

SEQ ID NO: 183033 - DNA, 1750 bp, Homo sapiens
  Payload ID: 16058
  Gene Symbol: SLC17A3
  Gene Name: solute carrier family 17 (organic anion transporter), member 3
  Uniprot ID: O00476
  ENST ID: ENST00000360657
  CDS Start-End: 287-1549
gtcggggccagagcgcaggtgtacctggcggccgtgctggagcacctgaccgccgagatcctggagctggctggcaacccggcccgcgacaagaagacccgcatcatcctgcgccacctgtagctggccattcgcaacggcgaggagcttaacaagctgctgggcgaagtcaccatcgcgcagggcggtgtcctgcccaacattcagggcgtgcttctgccccagaagaccaagagccaccacaaggccaagggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaa

SEQ ID NO: 183034 - DNA, 1543 bp, Homo sapiens
  Payload ID: 16058
  Gene Symbol: SLC17A3
  Gene Name: solute carrier family 17 (organic anion transporter), member 3
  Uniprot ID: O00476
  ENST ID: ENST00000361703
  CDS Start-End: 80-1342
ggaaacgctgggttcaacttgaagcccttccacagacattaagtcggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaa

SEQ ID NO: 183035 - DNA, 2052 bp, Homo sapiens
  Payload ID: 16058
  Gene Symbol: SLC17A3
  Gene Name: solute carrier family 17 (organic anion transporter), member 3
  Uniprot ID: O00476
  ENST ID: ENST00000397060
  CDS Start-End: 111-1607
gctccaaaaagtccaagggagtaagcttggaggaaacgctgggttcaacttgaagcccttccacagacattaagtcggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaatgcagttgtcatcttcatagaattaacaatggattaagagggcttgctgtgtgggacccagtatgttagattccattactggatacaagaaacaatgttttaaaacctttaatccggggtgacaaactcactagggcaatgatttttcctgtttgtgaaaattaatattactttctatttattgggttgagtattgtccatgtgttcttccctatatgtcctccatttatctccatcctgctca

SEQ ID NO: 183036 - DNA, 563 bp, Homo sapiens
  Payload ID: 16058
  Gene Symbol: SLC17A3
  Gene Name: solute carrier family 17 (organic anion transporter), member 3
  ENST ID: ENST00000449356
  CDS Start-End: 69-407
aactgatgcatgtgaattacatatctccctgataggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcct

SEQ ID NO: 183037 - DNA, 599 bp, Homo sapiens
  Payload ID: 16058
  Gene Symbol: SLC17A3
  Gene Name: solute carrier family 17 (organic anion transporter), member 3
  ENST ID: ENST00000481949
  CDS Start-End: 1-299
tgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagaaaatgccagaaattgcccagcatgaaacaggacagtacaaacattctgcaacacacagaagaggaccagcagaatctggacttttgaaaaagaaaaaatctaactgaataacaacatcaaagtctcctgggcaaaggggttaaagatttacaacatttctttagaggaaaaaaataactggttgaatttacagagcatctgctatgtgccaaacatttaatgagcactttaaaagcatgataaaaattaaaaaaaaacttgttaagcatgaaataaattacctataatgcaaaatca

SEQ ID NO: 183038 - DNA, 661 bp, Homo sapiens
  Payload ID: 16058
  Gene Symbol: SLC17A3
  Gene Name: solute carrier family 17 (organic anion transporter), member 3
  ENST ID: ENST00000505420
  CDS Start-End: 1-156
agtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaaggcagtaccaaccttggacagggatggggtaatgattcacatttatggggggaaaaattatctttgtgtgactccagtcacagtttgcttctatcaaatcttcagtctccaatgaagtttaaatattcctgggaatcctaatgaaggactgtttttatgagttttgtgttatcattgtaatgtcaagattgtgtgtcaagtcaatatgaagtttaaaaccatttccaatatgttcacttgatttactcttttccattatttggatatcccattacacaggcacagtggatgatttaagtattccaggaagctgtttctataccaaagtacctagcaataatgtaacaattccccttatcaacccaaaccacataaatgtatcccaaattttggtccaatgaaatgcattcccactgcagccttcccttcaccatatcaaaaaatgccaagagcaactccatagtactatggtacccaataggatggagatagtaactttaaaca

SEQ ID NO: 183039 - DNA, 1362 bp, Homo sapiens
  Payload ID: 16058
  Gene Symbol: SLC17A3
  Gene Name: solute carrier family 17 (organic anion transporter), member 3
  ENST ID: ENST00000506105
  CDS Start-End: 103-441
aagtccaagggagtaagcttggaggaaacgctgggttcaacttgaagcccttccacagacattaagtcggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtacatataaagacaccaacacttttctgagaccttgtatctggattttcttgaggccttaaatctggatttttaagggtgactaagtgtgtgagcatctgtcggatttaccgttatgaccagtaaatttgttttcaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacgtgagtatgtttccttcccttcctttctcctgcttgcatggctgaccaattactctgccctcactaatcattccatctgagaaatgtatttcttattaccaaaaataatctaatatttaatactcatgccagtagcttttctggggtatgatttaagaggttactgattttcctaagaaagtatgatttcagaatgtcattattattagtagtaatttatcaacaaaagttgtggtctcactgcctttattatggtaatttactcaatcttttctctttagaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgcctta

SEQ ID NO: 183040 - DNA, 3949 bp, Homo sapiens
  Payload ID: 16059
  Gene Symbol: SLC17A6
  Gene Name: solute carrier family 17 (vesicular glutamate transporter), member 6
  Uniprot ID: Q9P2U8
  ENST ID: ENST00000263160
  CDS Start-End: 438-2186
gcttctgtgatattccggcccctccgtttaaaagccatcagatttgagagcaataagtcttcaaaaccgggaatttacattgtttttcagctgaccgacttccaggaaaaggactcaaccgcatctacccaaataccgtggcactgcttgcgctctttgccaccggatcctccccttccaatgagactttctgattgtgtctaccaactctcctattaggaaacccgtgggttgcatgcagctattctgttgtattctcattctcactctccctcccttctctcactctcactcttgctggaggcgagccactaccattctgctgagaaggaaaagcccgcaactactttaagagattaagacaatatgcgcaatcctcgcctttcctagcaatcactatttaaatctggcaagaactgacaacagtctttgcaagaatggaatccgtaaaacaaaggattttggccccaggaaaagaggggctaaagaattttgctggaaaatcactcggccagatctacagggtgctggagaagaagcaagacaccggggagacaatcgagctgacggaggatgggaagcccctagaggtgcccgagaggaaggcgccgctgtgcgactgcacgtgcttcggcctgccccgccgctacattatcgccatcatgagcggcctgggcttctgcatctccttcggtatccgctgcaacctgggcgtggccattgtggacatggtcaacaacagcaccatccaccgcgggggcaaggtcatcaaggagaaagccaaattcaactgggacccggaaaccgtggggatgatccacggttccttcttttggggctacatcatcactcagattccgggaggctacatcgcgtctcggctggcagccaacagggttttcggagctgccatacttcttacctctaccctaaatatgctaattccatcagcagccagagtgcattatggatgtgtcatctttgtcagaatactgcagggacttgttgagggtgtgacctacccagcatgtcatgggatatggagcaaatgggccccacctctagagaggagtagactggcaaccacctccttttgtggttcctatgccggagctgtgattgcaatgcctttagctggcattcttgtgcagtacactggctggtcttcagtgttttatgtctacggaagctttggaatggtctggtacatgttttggcttttggtgtcttatgaaagtcctgcaaagcatcctactattacagatgaagaacgtaggtacatagaagaaagcattggagagagtgcaaatcttttaggtgcaatggaaaaattcaagactccatggaggaagttttttacatccatgccagtctatgcaataattgttgcaaacttctgcagaagctggactttttatttattgcttattagtcagccagcatattttgaggaagtctttggatttgaaattagcaaggttggtatgctatctgctgtgccacacttagtaatgacaattattgtgcctattgggggacaaattgcagattttctaagaagcaagcagattctttcaactacgacagtgagaaagatcatgaattgtggtggttttggcatggaagccacactgctcctggtcgttggctattctcatactagaggggtagcaatctcattcttggtacttgcagtgggattcagtggatttgctatatctggtttcaatgttaaccacttggatatcgctccaagatatgccagtatcttaatgggcatttcgaatggtgttggcacattgtcaggaatggtttgtcctatcattgttggtgcaatgacaaagaataagtcacgtgaagagtggcagtatgtcttcctgatcgctgccctagtccactatggtggagttatattttatgcaatatttgcctcaggagagaaacaaccctgggcagacccggaggaaacaagtgaagaaaaatgtggatttattcatgaagatgaactcgatgaagaaacaggggacattactcaaaattatataaattatggtaccaccaagtcttatggtgccacaacacaggccaatggaggttggcctagtggttgggaaaagaaagaggaatttgtacaaggagaagtacaagactcacatagctataaggaccgagttgattattcataacaaaactaattactggatttatttttagtgtttgtgattaaattcattgtgattgcacaaaaattttaaaaacacgtgatgtaaacttgcaagcatatcaaccaggcaagtcttgctgtaaaaatgaaaacaaaacaaacccatgaggttaccatcaagtgcaatctgtaaaattgtgaagttccatcatttccattcaagtcatccattcttgcatttgtgacttaaaggttgactggtcaaaattgtagaaacaagtagttacccattggattcatatgagctaaaactcatcactatttactaaagcacaacatctcatcctacaaaagttaagaagccaaagctacttgatcatgcaaaatgcacttatatatttgttacactgtattgcaagatagcacacagaagttggctgcgtcaagtagaggcgacatttattaagtgaaaatcatggagttgggatatctctcaattaaagaaatacattgtgaactatcagctacaaagttgtactgaataactattagaattgcataatgtgagatattttgttagtcctcaaaaggaatatcttgcagtgttttctatgaaatgcttgggcacaaacacttatttctgtgaaagagaacatgtaagttgaggggtatgcttcatgttcttccatccatttacctaatagtatgaaacagttcacatttcaataaaatcaaacttttcatgtagcgtatcacataacttttttgcaaaaaatataaaaagaaataaacttcaatgtattttttattacaactttgtactggttgtaacttgcattagaaaaaaaagagatatatacaccacaaagaatctaataagaaatttattatggagatatagcccttaaaatgcaatattaagaacaaagaaatagaaaatggtttagatatctttcttccttcataattaaatactatatgaaacttgtgccacagagctatatataatatgaaaagattaacttcatagagatattgtaagtaggtaattttattatttaaagtcctattaagaaatatttgtcttaaatatataggacaatacattatattaaaatggtctctctctatatatatctgtatatcttatacatgtccatacacagaaacataataaacaatcttcacacgaaaccaaaaatagcatacacctaatgttgggttagggaattgcaatttctactttcatagagtcatagaattttaggtggggaagaggcattttgcttgtcatttcttaatataactcaacaagaattgcaacatttgtgtaccaagcaataagtgcaatgcataaaatttcctgtctgtatattaccttcattttgcttgtagtagctgtttgggtggttggaataattttatttttcttttaaaaaagctaacatcagacccctttataatgtcctaaaattatgataatacatttcccaattcaactcaaaatattattggtgtattttgtctattctggatatttgatctgttcaatgtactgtgctagtgactggaggccctgctactgcaaatataaaacataaagtttgtttaaaaaaatgcaaatcattctttaccttaagaaaaaaaaaataccctttgctttgtgcctcaaagtgatgtaatgtgatcacagcttttgttgtgttgaatgaaaatatgtggactgtcattttgttgcagcaaaaaagtgttaataaaatgctctatttatcctttttttaaaaa

SEQ ID NO: 183041 - DNA, 2973 bp, Homo sapiens
  Payload ID: 16060
  Gene Symbol: SLC17A7
  Gene Name: solute carrier family 17 (vesicular glutamate transporter), member 7
  Uniprot ID: Q9P2U7
  ENST ID: ENST00000221485
  CDS Start-End: 173-1855
tgtgacagcccccgggccgcctgcacttgcagcctccttccccccgagcggagctgcggggccggccgggccggggctggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagccaggggtgttttttcccagtgcagggttgtgtctttgtgtctctgtctctgtgactgtaaatcctgccctgccccactcccaataaaagctttggtgtataggc

SEQ ID NO: 183042 - DNA, 2237 bp, Homo sapiens
  Payload ID: 16060
  Gene Symbol: SLC17A7
  Gene Name: solute carrier family 17 (vesicular glutamate transporter), member 7
  Uniprot ID: Q9P2U7
  ENST ID: ENST00000600601
  CDS Start-End: 223-1704
gaactcagagcgcggacagatcccagaggagcagagaaataacacaatggggagactatggggtcgcagctggcactggcgggccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctga

SEQ ID NO: 183043 - DNA, 553 bp, Homo sapiens
  Payload ID: 16060
  Gene Symbol: SLC17A7
  Gene Name: solute carrier family 17 (vesicular glutamate transporter), member 7
  ENST ID: ENST00000596689
  CDS Start-End: 1-350
tctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaactacactgtggtccctgaagggacgcggagaagccctcagccccgctccccgtcttagcggccctcccctcgcccccacagaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctg

SEQ ID NO: 183044 - DNA, 3983 bp, Homo sapiens
  Payload ID: 16061
  Gene Symbol: SLC17A8
  Gene Name: solute carrier family 17 (vesicular glutamate transporter), member 8
  Uniprot ID: Q8NDX2
  ENST ID: ENST00000323346
  CDS Start-End: 314-2083
gagagtggctgcctgagacagctgccacaggctgctgcagagcgtgcagcttttgcaagggactgaattcccagccagacaccccttggactcttttttggaggggtggggagcagagagaggagggagttgtcttatcttggaagatccgagctgggtttcatctcctttttgattttgagtagttccctccacgagaactgacttccaggtgttcaccaagggaaacaaggtggttctcacactggaaatgaggaaggatgacagtttttgagactgactgttaacggctcagaggtgcccctcattcaaaatgccttttaaagcatttgataccttcaaagaaaaaattctgaaacctgggaaggaaggagtgaagaacgccgtgggagattctttgggaattttacaaagaaaaatcgatgggacaactgaggaagaagataacattgagctgaatgaagaaggaaggccggtgcagacgtccaggccaagccccccactctgcgactgccactgctgcggcctccccaagcgttacatcattgctatcatgagtgggctgggattctgcatttcctttgggatccggtgcaatcttggagttgccattgtggaaatggtcaacaatagcaccgtatatgttgatggaaaaccggaaattcagacagcacagtttaactgggatccagaaacagtgggccttatccatggatcttttttctggggctatattatgacacaaattccaggtggtttcatttcaaacaagtttgctgctaacagggtctttggagctgccatcttcttaacatcgactctgaacatgtttattccctctgcagccagagtgcattacggatgcgtcatgtgtgtcagaattctgcaaggtttagtggagggtgtgacctacccagcctgccatgggatgtggagtaagtgggcaccacctttggagagaagccgactggccacaacctctttttgtggttcctatgcaggggcagtggttgccatgcccctggctggggtgttggtgcagtacattggatggtcctctgtcttttatatttatggcatgtttgggattatttggtacatgttttggctgttgcaggcctatgagtgcccagcagctcatccaacaatatccaatgaggagaagacctatatagagacaagcataggagagggggccaacgtggttagtctaagtaaatttagtaccccatggaaaagatttttcacatctttgccggtttatgcaatcattgtggcaaatttttgcagaagctggaccttttatttgctcctcataagtcagcctgcttattttgaagaggtctttggatttgcaataagtaaggtgggtctcttgtcagcagtcccacacatggttatgacaatcgttgtacctattggaggacaattggctgattatttaagaagcagacaaattttaaccacaactgctgtcagaaaaatcatgaactgtggaggttttggcatggaggcaaccttactcctggtggttggcttttcgcataccaaaggggtggctatctcctttctggtacttgctgtaggatttagtggcttcgctatttcaggttttaatgtcaaccacctggacattgccccacgctatgccagcattctcatggggatctcaaacggagtgggaaccctctctggaatggtctgtcccctcattgtcggtgcaatgaccaggcacaagacccgtgaagaatggcagaatgtgttcctcatagctgccctggtgcattacagtggtgtgatcttctatggggtctttgcttctggggagaaacaggagtgggctgacccagagaatctctctgaggagaaatgtggaatcattgaccaggacgaattagctgaggagatagaactcaaccatgagagttttgcgagtcccaaaaagaagatgtcttatggagccacctcccagaattgtgaagtccagaagaaggaatggaaaggacagagaggagcgacccttgatgaggaagagctgacatcctaccagaatgaagagagaaacttctcaactatatcctaatgtctgagaggcacttctgtcttctccttactttagaaacagaaagtatccatacctattgcctttcttgtagcccagcttgccagaggtccaaatattgggaggggagaagatctaaccagcaacagggaaaagagaaatattatctttcaatgacatgtataggtaaggagctgcgctcagttgataacatagttgataatacatattttttgaattgacagttgacccttctctcaaagagctaaacttattcagaaaggaatgactagaagaaaaaggagacaataccatgttgttcaaagaaacattgaaggaaattgggatgtttggccagaaggaatgtaaacagtagtagtagctgccaccacatctctagggtagccatgcagaggagggcttcatattcccaataaaccccacgttgtggcaggtgctttataaacactcttatttaatctccacacctttatgacacacatttcttatccccattttacaaccaaggcatctaaagcaacaagaaatgaacttgcccaaggtcatctgccagggtcagtgctgagactgttgaagctctcaataggtggcagttttagggaagatttccattcagtgtagggaagacatttgtaataatgaaaactgaaaatggagtaattgtgagtaactcaccactttagcaggtgttggggaagggaaacatttgggttgatgaggcagaggggattcaaatgtgtgagaggctagattcaaagaccctcagtgttctatgttatctgaagagtcaaatggttttgtgactccatagtttttaaagtaataagggtcaaagactacatcagagattcaaataggtttttaaagaaaagctaagcaagagagccaaatttttagaaatctgatggtcaaaatagctgaaagcagtaaacaagagattggctattaaatttcaactttccataatattaagaatgtagctaaatgatgtcccaaactacttacaaacttttaagacatttaataatttaagaagtaggttcatgtgttttcttaggtaaagttcttctgaaagaattttctatttttaaaaaatgtatctctttagccttttctgctggagattatattaggaagtttcatcagattgtataaaattatgattttgtatcaaaagtattcatgatgactctatttggaatgatattcagggaaatcacaataatatagcagtagttatacagagaaatactacaatgaaaacatttggggcaattagacctacagttactgttgaaaaattcacctttgattgcataaggcaattacatggatacttttagatatatttaaaattttaacattggcatctaaagtgttatttgaaaataaaattattttcctgttcattgattttaaacattttattcctactttcagaagaaaaatataatacggaaaaaattatagatttacttgtagcttattattgtaaagtgttttttttttttttttttttttctaatttctcccacatgtatttctggtccccagtgatactagctgagttgtagtgtattttataaatggaataatcttggggaaaaattgcgattcttcattaaataatattctttatgtcactagcatacaatttatgttagtagacatctttaaatctctttaatgagtgaatccatgcaagccccataaaacagttcctagcatgcagaaaatgcccacgtaaatagctgtcatcatcattatcttttaacattttgggggactttccagttgaaaagaaaacatgctatgtcatttttatccattatccctggaacttattgtgaaagttgtgctgttttctaagtaaaataaaaaataaaaaattagcaattta

SEQ ID NO: 183045 - DNA, 1737 bp, Homo sapiens
  Payload ID: 16061
  Gene Symbol: SLC17A8
  Gene Name: solute carrier family 17 (vesicular glutamate transporter), member 8
  Uniprot ID: Q8NDX2
  ENST ID: ENST00000392989
  CDS Start-End: 25-1644
gctcagaggtgcccctcattcaaaatgccttttaaagcatttgataccttcaaagaaaaaattctgaaacctgggaaggaaggagtgaagaacgccgtgggagattctttgggaattttacaaagaaaaatcgatgggacaactgaggaagaagataacattgagctgaatgaagaaggaaggccggtgcagacgtccaggccaagccccccactctgcgactgccactgctgcggcctccccaagcgttacatcattgctatcatgagtgggctgggattctgcatttcctttgggatccggtgcaatcttggagttgccattgtggaaatggtcaacaatagcaccgtatatgttgatggaaaaccggaaattcagacagcacagtttaactgggatccagaaacagtgggccttatccatggatcttttttctggggctatattatgacacaaattccaggtggtttcatttcaaacaagtttgctgctaacagggtctttggagctgccatcttcttaacatcgactctgaacatgtttattccctctgcagccagagtgcattacggatgcgtcatgtgtgtcagaattctgcaaggtttagtggagggtgtgacctacccagcctgccatgggatgtggagtaagtgggcaccacctttggagagaagccgactggccacaacctctttttgtggttcctatgcaggggcagtggttgccatgcccctggctggggtgttggtgcagtacattggatggtcctctgtcttttatatttatggcatgtttgggattatttggtacatgttttggctgttgcaggcctatgagtgcccagcagctcatccaacaatatccaatgaggagaagacctatatagagacaagcataggagagggggccaacgtggttagtctaagtgtgggtctcttgtcagcagtcccacacatggttatgacaatcgttgtacctattggaggacaattggctgattatttaagaagcagacaaattttaaccacaactgctgtcagaaaaatcatgaactgtggaggttttggcatggaggcaaccttactcctggtggttggcttttcgcataccaaaggggtggctatctcctttctggtacttgctgtaggatttagtggcttcgctatttcaggttttaatgtcaaccacctggacattgccccacgctatgccagcattctcatggggatctcaaacggagtgggaaccctctctggaatggtctgtcccctcattgtcggtgcaatgaccaggcacaagacccgtgaagaatggcagaatgtgttcctcatagctgccctggtgcattacagtggtgtgatcttctatggggtctttgcttctggggagaaacaggagtgggctgacccagagaatctctctgaggagaaatgtggaatcattgaccaggacgaattagctgaggagatagaactcaaccatgagagttttgcgagtcccaaaaagaagatgtcttatggagccacctcccagaattgtgaagtccagaagaaggaatggaaaggacagagaggagcgacccttgatgaggaagagctgacatcctaccagaatgaagagagaaacttctcaactatatcctaatgtctgagaggcacttctgtcttctccttactttagaaacagaaagtatccatacctattgcctttcttgtagcccagcttgccagaggtcca

SEQ ID NO: 183046 - DNA, 2594 bp, Homo sapiens
  Payload ID: 16062
  Gene Symbol: SLC17A9
  Gene Name: solute carrier family 17 (vesicular nucleotide transporter), member 9
  Uniprot ID: Q9BYT1
  ENST ID: ENST00000370349
  CDS Start-End: 205-1497
ccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggtggaaccaccctgtgtatgcatgaccctgacaagcaggcgccaggacagtcaggaggccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacaacagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaa

SEQ ID NO: 183047 - DNA, 3580 bp, Homo sapiens
  Payload ID: 16062
  Gene Symbol: SLC17A9
  Gene Name: solute carrier family 17 (vesicular nucleotide transporter), member 9
  Uniprot ID: Q9BYT1
  ENST ID: ENST00000370351
  CDS Start-End: 185-1495
cccgccctgccccgcctgcccgccctggtggccgtctgggggcgacaagtcctgagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacaacagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaagactgttattttatttaacacctttgttttttaagaatgaacacgtgttaaagactttctgtaactaatttcatgaggaaacgagtgacacgttggaatcaggtcaaaggagaatcccaggaacggactcctaggccgggagtgttgaaatgagcatgccagcagagccaggctgggtttcggggttcctttgccgccaggggtcctgcgtgtccacagatgacagcgatgtaccctgctatcagctgtccacccagctttcccaagatgtggggcccccatggagtcagacagcccagctgtgctgtggaaagacaaagtggagttttgcacttgagcacaaatgttcccctacaatctctccagtttcggtcagcccaaccctgtggcaccatgggtacagcctagagcatcacccccacagaggcttcgggacggtcctgctggactgctggacgctgctgtggggtcttggggcaggaggggcttccagaagcctggcagttgctgtctggaggccaggaagccaagcccaggaagcccacctgcggctgagttcagaggtggggcctgtgcgttgtgaatgaattgctgtctctctcctcctcatcttgcactaaatctacataacttaaaatttaccattttagccatttttaagtgcacggttctgtggcattaggtacattcgcattgtgcagccaccgccaccctccgccttcagaactttctcatcttcccaaaccgaagctctgtgctcattaaaggctagctccccgttgctctcccccagccccggcaaccccattccactttgtgtctcgaccgtaagtgtggctgctctgggaccagtgccagtgggcgcacgctgggtttgcctacgtctggcttacttcactcagcagagtgtccttcggttttatcagttttgtcacaagtgtcagcatttttctcatttttaaggctgaataaaatattgtgtggataa

SEQ ID NO: 183048 - DNA, 565 bp, Homo sapiens
  Payload ID: 16062
  Gene Symbol: SLC17A9
  Gene Name: solute carrier family 17 (vesicular nucleotide transporter), member 9
  ENST ID: ENST00000411611
  CDS Start-End: 109-565
ggaaggaagtgagtgccctgtccttcctccctgccatgagattccaggaccggacctggcaagtgccctatcccagccagtgttcctggggctcttccaggcagggctatgttccccaggccaggggcattgtcctggacagtcaggaggcatacccctcgccaggtggaaccaccctgtgtatgcatgaccctgacaagcaggcgccaggacagtcaggaggccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaag

SEQ ID NO: 183049 - DNA, 1493 bp, Homo sapiens
  Payload ID: 16063
  Gene Symbol: SLC17A2
  Gene Name: solute carrier family 17, member 2
  Uniprot ID: O00624
  ENST ID: ENST00000265425
  CDS Start-End: 22-1341
accatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgggctcctccttccatcaatatgtgctgtggccctgccctttgtggcctccagttacgtgataaccattattttgctgatacttattcctgggaccagtaacctatgtgactcagggtttatcatcaacaccttagatatcgcccccagatatgcaagtttcctcatgggaatctcaaggggatttgggctcatcgcaggaatcatctcttccactgccactggattcctcatcagtcaggttgggccagtttattgaacatcttcaagtggcaggattttgagtctggttggaggaatgtctttttcctgtctgctgcagtcaacatgtttggcctggtcttttacctcacgtttggacaagcagaacttcaagactgggccaaagagaggacccttacccgcctctga

SEQ ID NO: 183050 - DNA, 2270 bp, Homo sapiens
  Payload ID: 16063
  Gene Symbol: SLC17A2
  Gene Name: solute carrier family 17, member 2
  Uniprot ID: O00624
  ENST ID: ENST00000360488
  CDS Start-End: 419-1729
ggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcggaactgtaaagctataatccccagaattaaagtttttattattttttatacattgtaaaacatagacgtttatttatgtgattaaattctattaaaatttacatgctaaaataaaa

SEQ ID NO: 183051 - DNA, 2524 bp, Homo sapiens
  Payload ID: 16063
  Gene Symbol: SLC17A2
  Gene Name: solute carrier family 17, member 2
  Uniprot ID: O00624
  ENST ID: ENST00000377850
  CDS Start-End: 534-1970
aaaaccaagccgaggctttctgagaaagtggggccaaacctgttgccgtctgactgccacgtggctcactatttatccctgtaaaaatctgcaaaagtatttgaaagggaagaagggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgggctcctccttccatcaatatgtgctgtggccctgccctttgtggcctccagttacgtgataaccattattttgctgatacttattcctgggaccagtaacctatgtgactcagggtttatcatcaacaccttagatatcgcccccagatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcggaactgtaaagctataatccccagaattaaagtttttattattttttatacattgtaaaacatagacgtttatttatgtgattaaattctattaaaatttacatgct

SEQ ID NO: 183052 - DNA, 3616 bp, Homo sapiens
  Payload ID: 16064
  Gene Symbol: SLC17A4
  Gene Name: solute carrier family 17, member 4
  Uniprot ID: Q9Y2C5
  ENST ID: ENST00000377905
  CDS Start-End: 120-1613
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagactgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaa

SEQ ID NO: 183053 - DNA, 2331 bp, Homo sapiens
  Payload ID: 16064
  Gene Symbol: SLC17A4
  Gene Name: solute carrier family 17, member 4
  Uniprot ID: Q9Y2C5
  ENST ID: ENST00000397076
  CDS Start-End: 303-968
tcagtaagtaaatgccagtccctaggaagagagaaccaaaatgtctaccggaccagatgtcaaggctacagtgggggacatttccagtgatggcaatttaaacgtggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggtaagggagagactggacacaggggtgaacgtgggaagctcagagcagccttcagtttactctgtgtttgtcctcctaccccaggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtagggacctcttttgcctcatcctttcagacactcaattcaagtctagcagccctaaatctactctgatgtgaaagtaaaatgtggcaggtacaacaggttgcaggaaatgtcagcaccagctctacatcctacatctaaataattcctggaagagactcaaagctggtggaccattgtgaacttagtttttctgggcgtgaacaagaggagtcagtggccatgctcagagtcaactgagggagactcacacaaacctctctctgttgaggaatgcagcacttgcctaaggcggaatcactgaaagaaatcttgagattctatagggtatgctcatgaaaatctttaatgaaggcaaaggacacaggactgcaggagaaatatctgtctctgatacagtaaaaacagttgactgagacttccaaacatagctcccagggtgctgtcccagtcaacaggacatccttcatcttcagataatgaaccaccaagaaatgtgagagatgcccttgtcacaggggagccgacgtctcatctggtgaggggtcttttatacccacggagggtataaaagttacaagatcagactcaacagcagaagccaaaacaacaacaacaacaacaacaacaacaacaacaacaacaacaaaaaccttacaaaccaggtgcagaccatcaatctgaccatcttgcataaacaatgttgacaagttaatagaggttacccccttgggagtaccagtccctagcacaggattatactaatcattggtcagtacatttcattcaggtttcaccaaggcttacacaattccagtcatctccagaggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccg

SEQ ID NO: 183054 - DNA, 3699 bp, Homo sapiens
  Payload ID: 16064
  Gene Symbol: SLC17A4
  Gene Name: solute carrier family 17, member 4
  Uniprot ID: Q9Y2C5
  ENST ID: ENST00000439485
  CDS Start-End: 382-1713
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagactgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagc

SEQ ID NO: 183055 - DNA, 2420 bp, Homo sapiens
  Payload ID: 16065
  Gene Symbol: SLC18A3
  Gene Name: solute carrier family 18 (vesicular acetylcholine transporter), member 3
  Uniprot ID: Q16572
  ENST ID: ENST00000374115
  CDS Start-End: 441-2039
ggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgcgtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgtagagcctgcatctgtctgtccttccttccattgctcccagtgccaaacttgggccgctgcaccgcggcgcctccgcccaaatcaataaactgtgtctgtcccagga

SEQ ID NO: 183056 - DNA, 2770 bp, Homo sapiens
  Payload ID: 16066
  Gene Symbol: SLC18A1
  Gene Name: solute carrier family 18 (vesicular monoamine transporter), member 1
  Uniprot ID: P54219
  ENST ID: ENST00000265808
  CDS Start-End: 381-1862
gctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatcccagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcaggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattca

SEQ ID NO: 183057 - DNA, 2753 bp, Homo sapiens
  Payload ID: 16066
  Gene Symbol: SLC18A1
  Gene Name: solute carrier family 18 (vesicular monoamine transporter), member 1
  Uniprot ID: P54219
  ENST ID: ENST00000276373
  CDS Start-End: 268-1845
cacacacacacatacacagaatcctcagataacaggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattca

SEQ ID NO: 183058 - DNA, 1419 bp, Homo sapiens
  Payload ID: 16066
  Gene Symbol: SLC18A1
  Gene Name: solute carrier family 18 (vesicular monoamine transporter), member 1
  Uniprot ID: P54219
  ENST ID: ENST00000381608
  CDS Start-End: 1-1419
atgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggctattctgagtcaggactgccccatggagacccggatgtatgcaacccagaagcccacgaaggaatttcctctgggggaggacagtga

SEQ ID NO: 183059 - DNA, 2956 bp, Homo sapiens
  Payload ID: 16066
  Gene Symbol: SLC18A1
  Gene Name: solute carrier family 18 (vesicular monoamine transporter), member 1
  Uniprot ID: P54219
  ENST ID: ENST00000440926
  CDS Start-End: 472-2049
cacacacacacatacacagaatcctcagataacaggaggcaataaatccaacagcacatccacgttcagagaacagtgtccctgctgtcttgctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatcccagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattc

SEQ ID NO: 183060 - DNA, 2822 bp, Homo sapiens
  Payload ID: 16066
  Gene Symbol: SLC18A1
  Gene Name: solute carrier family 18 (vesicular monoamine transporter), member 1
  Uniprot ID: P54219
  ENST ID: ENST00000437980
  CDS Start-End: 472-1890
cacacacacacatacacagaatcctcagataacaggaggcaataaatccaacagcacatccacgttcagagaacagtgtccctgctgtcttgctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatcccagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaattc

SEQ ID NO: 183061 - DNA, 2770 bp, Homo sapiens
  Payload ID: 16066
  Gene Symbol: SLC18A1
  Gene Name: solute carrier family 18 (vesicular monoamine transporter), member 1
  ENST ID: ENST00000517776
  CDS Start-End: 187-1344
ctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtctaccaagttagaagtctaaatgaaacctttcagtgatgtccataatggaaaacagaggcaactttattccatgaagaatgagaccaggagtgtatgtttaggttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaacaggaggggtgtaatgtgacattgttcatacttgctaataaatacattattgcctaa

SEQ ID NO: 183062 - DNA, 952 bp, Homo sapiens
  Payload ID: 16066
  Gene Symbol: SLC18A1
  Gene Name: solute carrier family 18 (vesicular monoamine transporter), member 1
  ENST ID: ENST00000522513
  CDS Start-End: 179-952
ttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttagtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgag

SEQ ID NO: 183063 - DNA, 1980 bp, Homo sapiens
  Payload ID: 16066
  Gene Symbol: SLC18A1
  Gene Name: solute carrier family 18 (vesicular monoamine transporter), member 1
  Uniprot ID: P54219
  ENST ID: ENST00000519026
  CDS Start-End: 234-1715
ggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcaggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgatta

SEQ ID NO: 183064 - DNA, 3852 bp, Homo sapiens
  Payload ID: 16067
  Gene Symbol: SLC18A2
  Gene Name: solute carrier family 18 (vesicular monoamine transporter), member 2
  Uniprot ID: Q05940
  ENST ID: ENST00000298472
  CDS Start-End: 144-1688
gagcggcggcggcggggcgctggggcggagactgcgacccggagccgcccggactgacggagcccactgcggtgcgggcgttggcgcgggcacggaggacccgggcaggcatcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctgaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgtgaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgccactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatg

SEQ ID NO: 183065 - DNA, 2368 bp, Homo sapiens
  Payload ID: 16068
  Gene Symbol: SLC18B1
  Gene Name: solute carrier family 18, subfamily B, member 1
  Uniprot ID: Q6NT16
  ENST ID: ENST00000275227
  CDS Start-End: 98-1468
gcggccgcccgccagagtgccagtggctccttggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatgttttgctttgttcgagttgctggcatccttggtatttggaaactatcttgtacatattggagcaaaatttatgtttgtagcaggaatgtttgtctcaggaggagttacaattctctttggtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctca

SEQ ID NO: 183066 - DNA, 472 bp, Homo sapiens
  Payload ID: 16068
  Gene Symbol: SLC18B1
  Gene Name: solute carrier family 18, subfamily B, member 1
  ENST ID: ENST00000367918
  CDS Start-End: 67-390
tggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtc

SEQ ID NO: 183067 - DNA, 3811 bp, Homo sapiens
  Payload ID: 16069
  Gene Symbol: SLC19A1
  Gene Name: solute carrier family 19 (folate transporter), member 1
  Uniprot ID: P41440
  ENST ID: ENST00000311124
  CDS Start-End: 154-1929
agccgcgcgcccgccgcgccgccttgtgggcgctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactc

SEQ ID NO: 183068 - DNA, 1884 bp, Homo sapiens
  Payload ID: 16069
  Gene Symbol: SLC19A1
  Gene Name: solute carrier family 19 (folate transporter), member 1
  Uniprot ID: P41440
  ENST ID: ENST00000380010
  CDS Start-End: 154-1623
agccgcgcgcccgccgcgccgccttgtgggcgctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 183069 - DNA, 3572 bp, Homo sapiens
  Payload ID: 16069
  Gene Symbol: SLC19A1
  Gene Name: solute carrier family 19 (folate transporter), member 1
  ENST ID: ENST00000417954
  CDS Start-End: 1-809
agctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggccttaaggatgtcccggcccagactcggcctctgcctgcctggtcccttcccaccccagagtgcagccccagcaagagcaggtatggcggcctcctctgcagaggaccctggcagcgagaggggaccctggcggcgagcggggaccgtggcggcgagaggggaccctggcggcgagaggggaccgtggcggcgagaggggaccctggcggcgagaggggaccctggcggcgagaggggaccgtggtggcgagagggaaccctggcggcaaaaccgagaatgcagtgggtcactcgggccacggctccctgaggacaggaactggccccggccccacctcatcccacgctggagtcgtgcacagacgtccctcgggaggagtgaagaggccaccgggtctgcgtctcaggtaaaaaggtgactgaaaatgccccaccctgctgacatcagggagacaaagctcttggctcaaaagacagcagagtggacacctttgggctgagcgggagaacccccagcatggagggcttggagggcatggagggcatggagggcatagagggcatggagggcatggcccaggcccatggatgccctgctgagaatccacaggggcctgttgtatgtgtgtatatgggtgcacatgtgtgcatatatgtgtattggtgtgtatgcatgtgtatatgtatgtgtgcatgagtatacatgtgcagtgtgtatgcccatcatggaatgggccagggagggctcatagtcatgtatgtggatacacatgtggatacgtgcacatgtatgagtgtatgtatatacctgtatgggtgtgcacgtggacaggctcgtatatgcatgaatacatgtgtatatgtgcacctatgtggagtgtatgggcatgtgtacacacatgagcacgtgtggatgtgtgtgtgcgtgtatgtgtgcgcgtgtgtatgggcatgtatgtgcatagatgcatgtgtatatgtgcacacatgtatgagtacggccatatatgtgcatgcatgtttgggcacacgtgtgcgtgtgtggacatgtatgactgtgcatgggtatggcatgaccagtgctgtgtggccacatggcagggctgcttataagtggcctctgggaggagctgcaggaccccaggctgtggccaggccattcccaggtcctggtctcccagccacccagtccgccccttgagagacactcaccctcatgccaaatccaaggctggcatctcccggctcccctttctctcctttcaatccgttcatcccggggcgaccctggggcggagcacagggggtggggactgctgggcactgatgattaccagacaccttcccgcagggtgcctgccgttagccccacgccaggcccggccggcccacgctcagcctcacacgttcccagctctcaggctaccccggcccttctcacccctttcctgcacaaggacccttttgggaggaggtgactgagcctagcacacacaggcccactgccctgtctgcctccagggcttcctcctgggtactggcccctcgtggggtactgccagccacatccaggacaagagctgcgctcaggcagggccggttcttgggggaggacagtgggtgcggcggccgtccactcccctctgggcatgtcacccccgtgggcctgggctgctccccacctgccagaccccatctgccgcccccactggagaccccaggtcctcaccggccgtccaggaaagccaatctctcccttgtaccccggccgtccgtatggaccctgcaagaggaagggggccaggcttagtggggcagaccctggcccttgaccacgagttggggggtcctggggaaggggaggggccatgcagagcacagcaccctgggccacccatcagctcggaggagcccactgcagcctcacgccgacacctgccccacacgctttaaaactgcactagggagatgagccctgggccgcacagcacaagctcagcagccgcgggcgaccgtgtccttgggggccgtcatgcccgagctcagtgcagagaaagccagggaccgacttaccgggggtcctcggaagcccggctctccctgagcaaaaaaacaagaagacagggttaggtggcagcttgtgccccacctggcagcctctctgagggcccctgtggcgaaggcacggttaggtggcggcttgtgccccacctgatagcctccctaagggccgctgtggtccctttgggtgcactgggccgtccccaaggcgcaggcagccctggggaggacaggagccactggtgaggggagggtcgggtttggggtttgcgtccaggttggtgcgtgcatgcatgccccgggaccctgaagcaggggtggagggtggagggtggagggcatgtgccacgcagtgtcctggttgccacaggccccagctccaatgcacagctgggtgggatagtggagctctcactgggcctggggatcctgtgtctgaggcccaccccaaacaccccggagggctcactgctccctctgaaagtgggagagccggtggcccacactccaaagatccaggcttctccccaggaccctccccgagggcttttctgggcggctgcctgctgggggtggggacgcaggcacaggccccttgaggaactgactccgggccctgcccacagcatcagggcccccaggaagaggctggaggggcagccagaaacctgctgaggctgagctggtacagcctgggctcctgcaccccacaggccaggccccagggaggcgcgagctcagagctgcagcccactgagaacctcccctcagcagggtgggctcaggggtagggagaggacgaggggcagggagaggacgaggggccggcggaaccgccgacatgggtgcgagaaaggaggggccaccagggccaggcctggatggtagagccctgcttgggagaggctcgtgcatcaggagccagaccctcaggaagaccctccccaggctgtctccacagccccaggagcccccacgcctgccggaaggaggctgcccggccctcaccttg

SEQ ID NO: 183070 - DNA, 648 bp, Homo sapiens
  Payload ID: 16069
  Gene Symbol: SLC19A1
  Gene Name: solute carrier family 19 (folate transporter), member 1
  ENST ID: ENST00000427839
  CDS Start-End: 102-648
gtggatccggcgttcgcgcccaggcacgtgttgcttcgggacgggccagccggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttct

SEQ ID NO: 183071 - DNA, 777 bp, Homo sapiens
  Payload ID: 16069
  Gene Symbol: SLC19A1
  Gene Name: solute carrier family 19 (folate transporter), member 1
  ENST ID: ENST00000443742
  CDS Start-End: 314-777
tcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggcta

SEQ ID NO: 183072 - DNA, 580 bp, Homo sapiens
  Payload ID: 16069
  Gene Symbol: SLC19A1
  Gene Name: solute carrier family 19 (folate transporter), member 1
  ENST ID: ENST00000528477
  CDS Start-End: 399-580
agtcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacagcagggccaggttctgcccacccgtggagaaggccagtacaggggagagagccagggctcccacaaagcagggggtccctccaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcg

SEQ ID NO: 183073 - DNA, 1896 bp, Homo sapiens
  Payload ID: 16069
  Gene Symbol: SLC19A1
  Gene Name: solute carrier family 19 (folate transporter), member 1
  Uniprot ID: P41440
  ENST ID: ENST00000485649
  CDS Start-End: 101-1756
ggccgttgaggaggtgcagggagaggagcgggagggctctgggtggctgccaagggggagctctgcgctcagaccctcaactaagaccaggaggtgcctgatgaggccccagcctgcagagccagctcctggtggaagaggaaatgaggcatgctccattcattcggaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtg

SEQ ID NO: 183074 - DNA, 2029 bp, Homo sapiens
  Payload ID: 16069
  Gene Symbol: SLC19A1
  Gene Name: solute carrier family 19 (folate transporter), member 1
  ENST ID: ENST00000567670
  CDS Start-End: 325-1962
actcctcgcagtcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggccttaaggatgtcccggcccagactcggcctctgcctgcctggtcccttcccaccccagagtgcagccccagcaagagcaggtatggcggcctcctctgcagaggaccctggcagcgagaggggaccctggcggcgagcggggaccgtggcggcgagaggggaccctggcggcgagaggggaccgtggcggcgagaggggaccctggcggcgagaggggaccctggcggcgagaggggaccgtggtggcgagagggaaccctggcggtgagaggggaccctggcggcgagaggggaccgtggcggcgagaggggaccctggtggtgaaaggcgcccgaggctagcctggctctctgggcttctgctctgccagcccccagacatcctcaaacagtggttttctcacatttt

SEQ ID NO: 183075 - DNA, 3671 bp, Homo sapiens
  Payload ID: 16070
  Gene Symbol: SLC19A2
  Gene Name: solute carrier family 19 (thiamine transporter), member 2
  Uniprot ID: O60779
  ENST ID: ENST00000236137
  CDS Start-End: 238-1731
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaa

SEQ ID NO: 183076 - DNA, 2976 bp, Homo sapiens
  Payload ID: 16070
  Gene Symbol: SLC19A2
  Gene Name: solute carrier family 19 (thiamine transporter), member 2
  Uniprot ID: O60779
  ENST ID: ENST00000367804
  CDS Start-End: 166-1056
gggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtata

SEQ ID NO: 183077 - DNA, 3105 bp, Homo sapiens
  Payload ID: 16071
  Gene Symbol: SLC19A3
  Gene Name: solute carrier family 19 (thiamine transporter), member 3
  Uniprot ID: Q9BZV2
  ENST ID: ENST00000258403
  CDS Start-End: 73-1563
atccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattagctgggcagcgtggtgtgtgcctgtagtctcagctacttgggaggccatggtgggaggatgggttgagcacaggagtcagaggctacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacagtctcgctctctcacccaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaa

SEQ ID NO: 183078 - DNA, 644 bp, Homo sapiens
  Payload ID: 16071
  Gene Symbol: SLC19A3
  Gene Name: solute carrier family 19 (thiamine transporter), member 3
  ENST ID: ENST00000409287
  CDS Start-End: 71-349
ccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaa

SEQ ID NO: 183079 - DNA, 594 bp, Homo sapiens
  Payload ID: 16071
  Gene Symbol: SLC19A3
  Gene Name: solute carrier family 19 (thiamine transporter), member 3
  ENST ID: ENST00000409456
  CDS Start-End: 433-594
gcgggtgcgtggtcgtgcggcaagtgagcgatttggtgaacagacactcccttctgtagtgacaaatgagatcctctattgggctttatgtctaaagcttgcatttcaagcaatttcctcactcgaggtcaggagttcaagaccagcctggccaacatggtgaaaccccatctctactaaaaatacaaaattatccagtcatggtggcaggcacctgtaatcccagctacttgggaggctgaggcaggagaatggcttgagcccgggaggcacaggttgcaatgggctgagatcatgccactgcacttcagcctggacaacagagcgaccctccatctcaaaaaaaaaaaaaaaatcaggttttcatcgcatcaaggatgctaaaaagaataagcatcacttaattttctctttgtttccatttgatcagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgag

SEQ ID NO: 183080 - DNA, 3517 bp, Homo sapiens
  Payload ID: 16071
  Gene Symbol: SLC19A3
  Gene Name: solute carrier family 19 (thiamine transporter), member 3
  Uniprot ID: Q9BZV2
  ENST ID: ENST00000425817
  CDS Start-End: 71-1561
ccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattagctgggcagcgtggtgtgtgcctgtagtctcagctacttgggaggccatggtgggaggatgggttgagcacaggagtcagaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaagagttgttaacattttttgatgaattctgctgaaaattatctgaacatacctgtttttcgaaacttcaagaaacttcaataagggatgcattgagcagtctgacagtgagaataaagaatgctgagtcaagatttatattaaggctggaagctgtggctcacacctgtaatcccagcattttgggaggctgaagtgagaggttaatttgagggtaggggtatgagaccatcttggccaatatagcaagaccctgtgtctaaaacaaacaaaaaaatttttaattggattttgatatggtttggatctgtgtccccaccaaatctcacgttgaagtgtaatccccaatgttagaggtggggccggctgggaggcgactggatcatgggtgtgaagccttcatgaatggtttggcaccgtcccctcagtgctggtctcatgacagtgagttatcgtgagatctggtagtttaaaagtgtgtagcacctccccactctctctttctcctgctttggccacgtgaagatgcctgctcccactttgccttctgccatgagtaaaaattccccgaggactccctagaagcagatgttgccacgcttcctatatagcctgtgagctaattaaaccccttttcttacaaacta

SEQ ID NO: 183081 - DNA, 852 bp, Homo sapiens
  Payload ID: 16071
  Gene Symbol: SLC19A3
  Gene Name: solute carrier family 19 (thiamine transporter), member 3
  ENST ID: ENST00000419059
  CDS Start-End: 660-852
aaatgatatctgtcttacagttattatgtagatttaaggagatagtatgcagaaaagcatcatacaacaaattagtttccttcctataaatgtatctcagagaacttagccacatgcaggaccatcaaaaatctataaacattacaataaggcaaagcttgagctaaaatgtggaggaattagtgaattttcctgtgcacatgataattcacatgagatagcaagatgttttcaaatatagctgccatacaatgattgttttttgttttttgtttcttctgtgcagtgacaaatgagatcctctattgggctttatgtctaaagcttgcatttcaagcaatttcctcactcgaggtcaggagttcaagaccagcctggccaacatggtgaaaccccatctctactaaaaatacaaaattatccagtcatggtggcaggcacctgtaatcccagctacttgggaggctgaggcaggagaatggcttgagcccgggaggcacaggttgcaatgggctgagatcatgccactgcacttcagcctggacaacagagcgaccctccatctcaaaaaaaaaaaaaaaatcaggttttcatcgcatcaaggatgctaaaaagaataagcatcacttaattttctctttgtttccatttgatcagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctgg

SEQ ID NO: 183082 - DNA, 563 bp, Homo sapiens
  Payload ID: 16071
  Gene Symbol: SLC19A3
  Gene Name: solute carrier family 19 (thiamine transporter), member 3
  ENST ID: ENST00000456524
  CDS Start-End: 167-563
attgctcttggcagctctgtctgaaggaggaggacaagagactccagggtatggaaagggattttcatagtggcgggcagcaggaaggagcagaagttggacctgaaggcaggaagccagcttggttctagaaagaaagaaactgggggcacagaaaaaaacagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagcc

SEQ ID NO: 183083 - DNA, 573 bp, Homo sapiens
  Payload ID: 16071
  Gene Symbol: SLC19A3
  Gene Name: solute carrier family 19 (thiamine transporter), member 3
  ENST ID: ENST00000431622
  CDS Start-End: 60-230
gggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagaggttgaagcatgccacaattaagacaacaaaggacagatgcagggtcagaagcaactcaatgaatccactgggttctgcttctcgagccactgtggaccagttaacagaccttccctccaaggagcagctcagttgtgtggtctttgctctgtggcctcctgctttctccagcaacctcagtgatccaggtgtcaagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatg

SEQ ID NO: 183084 - DNA, 533 bp, Homo sapiens
  Payload ID: 16072
  Gene Symbol: SLC2A1
  Gene Name: solute carrier family 2 (facilitated glucose transporter), member 1
  ENST ID: ENST00000372500
  CDS Start-End: 186-533
ggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtca

SEQ ID NO: 183085 - DNA, 865 bp, Homo sapiens
  Payload ID: 16072
  Gene Symbol: SLC2A1
  Gene Name: solute carrier family 2 (facilitated glucose transporter), member 1
  ENST ID: ENST00000439722
  CDS Start-End: 1-135
tccctctcagtggccatcttttctgttgggggcatgattggctccttctctgtgggccttttcgttaaccgctttggccgggtattacctctgacccagcccctcggagcccaaggaatgtgggcactggcctgacctgtgaccccgtccccaggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtgga

SEQ ID NO: 183086 - DNA, 3667 bp, Homo sapiens
  Payload ID: 16072
  Gene Symbol: SLC2A1
  Gene Name: solute carrier family 2 (facilitated glucose transporter), member 1
  Uniprot ID: P11166
  ENST ID: ENST00000426263
  CDS Start-End: 523-2001
accattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtc

SEQ ID NO: 183087 - DNA, 2398 bp, Homo sapiens
  Payload ID: 16072
  Gene Symbol: SLC2A1
  Gene Name: solute carrier family 2 (facilitated glucose transporter), member 1
  ENST ID: ENST00000630287
  CDS Start-End: 198-719
agcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccagtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 183088 - DNA, 598 bp, Homo sapiens
  Payload ID: 16072
  Gene Symbol: SLC2A1
  Gene Name: solute carrier family 2 (facilitated glucose transporter), member 1
  ENST ID: ENST00000475162
  CDS Start-End: 1-427
tgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttatta

SEQ ID NO: 183089 - DNA, 4389 bp, Homo sapiens
  Payload ID: 16073
  Gene Symbol: SLC2A10
  Gene Name: solute carrier family 2 (facilitated glucose transporter), member 10
  Uniprot ID: O95528
  ENST ID: ENST00000359271
  CDS Start-End: 251-1876
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaa

SEQ ID NO: 183090 - DNA, 497 bp, Homo sapiens
  Payload ID: 16073
  Gene Symbol: SLC2A10
  Gene Name: solute carrier family 2 (facilitated glucose transporter), member 10
  ENST ID: ENST00000486000
  CDS Start-End: 39-80
cctcagcgcccccagcacgccgccgagtcccgctcgccatggcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcctggggacgctgtcgcgaacgaaactgcgaacaaaacagacgaaccccctcctctggacgtgattctgcagagaggggacagagaaggagattctaacacagcattggggtgggacgcgtggggaatggctttgttgccactcgggactagggctctatttttctctctgcattcagaagcctcgaaggatcagtcgttgattcttgagtgagcacctactacgtgccagacattgatataggggttagagcttcagcaatgaacaaaatagacaataaacctctctctcatgg

SEQ ID NO: 183091 - DNA, 1436 bp, Homo sapiens
  Payload ID: 16074
  Gene Symbol: SLC2A11
  Gene Name: solute carrier family 2 (facilitated glucose transporter), member 11
  ENST ID: ENST00000255830
  CDS Start-End: 15-311
cccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgc

SEQ ID NO: 183092 - DNA, 1555 bp, Homo sapiens
  Payload ID: 16074
  Gene Symbol: SLC2A11
  Gene Name: solute carrier family 2 (facilitated glucose transporter), member 11
  Uniprot ID: Q9BYW1
  ENST ID: ENST00000316185
  CDS Start-End: 38-1537
tgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccag

SEQ ID NO: 183093 - DNA, 3219 bp, Homo sapiens
  Payload ID: 16074
  Gene Symbol: SLC2A11
  Gene Name: solute carrier family 2 (facilitated glucose transporter), member 11
  Uniprot ID: Q9BYW1
  ENST ID: ENST00000345044
  CDS Start-End: 269-1759
ctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgtgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaa

SEQ ID NO: 183094 - DNA, 2388 bp, Homo sapiens
  Payload ID: 16074
  Gene Symbol: SLC2A11
  Gene Name: solute carrier family 2 (facilitated glucose transporter), member 11
  Uniprot ID: Q9BYW1
  ENST ID: ENST00000398356
  CDS Start-End: 190-1701
cggacctgcctctcacgcaatggatcccctggcggcaacccgagaccggttctcctacccgcattccgccaagtctctcgctctgcccaggacgcacagatgagagcgctccgaagactgagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctacc

SEQ ID NO: 183095 - DNA, 730 bp, Homo sapiens
  Payload ID: 16074
  Gene Symbol: SLC2A11
  Gene Name: solute carrier family 2 (facilitated glucose transporter), member 11
  ENST ID: ENST00000405847
  CDS Start-End: 38-577
attccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcaggtaagcacccctcccccacatgcattgagtatttcggagataccagtaaaagcgtttcttcacctaaatgtctcccctacccactagtagattaaagcattattgctttgcatgaaggcatcgaatcctctatccacatctctgctgccaattcacg

SEQ ID NO: 183096 - DNA, 2748 bp, Homo sapiens
  Payload ID: 16074
  Gene Symbol: SLC2A11
  Gene Name: solute carrier family 2 (facilitated glucose transporter), member 11
  ENST ID: ENST00000405340
  CDS Start-End: 218-886
caggctgccggctcaccgcttgctaatggcagccggggtctccctgggacagcaagacctccgctcaggcccctctttcgaatgctccacgccctcctgcgatctagaatggtatgaattctcatacttgcccagaccaggcgtttcagatgagggattgcggacctgagtgaactgcgcaggtgcagccacctgggaggcttaactaagtcgtcaaatgttcaaaaatatcgtgcttattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcaggtcagggagcaaagaacaggtcttcacagaggagagggtgaagatttgggctttcaaagacaaacgtgttccagtcattccagaaaaaagaggagaaggcagagcctggacccttgggaagaggagttgctagggatgaggtggggcagtggccctgtcctctcttggtcccaacctgggtgggagggatcttgatgttcagacccagacttggataggaagaggcacggggcaattgcagactccctgcagggaggtgtgtaggtgggcaggagagcagggtggtaggactctggcaaagaggcatctggcctggcctctcctctgcctccttagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaa

SEQ ID NO: 183097 - DNA, 564 bp, Homo sapiens
  Payload ID: 16074
  Gene Symbol: SLC2A11
  Gene Name: solute carrier family 2 (facilitated glucose transporter), member 11
  ENST ID: ENST00000403208
  CDS Start-End: 109-423
agcataagtcggacctgcctctcacgcaatggatcccctggcggcaacccgagaccggttctcctacccgcattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggcccacctctaaataccgttgcattggaaattaaatttcaacctgaattttggaagagacacaaaccttcaaaccatagcaccagcactggatcagcaagactggattagaccactgggctcatatctgcaccgtggggagtaggggaacagtcgcaaacaaaagtggggctctt

SEQ ID NO: 183098 - DNA, 559 bp, Homo sapiens
  Payload ID: 16074
  Gene Symbol: SLC2A11
  Gene Name: solute carrier family 2 (facilitated glucose transporter), member 11
  ENST ID: ENST00000418102
  CDS Start-End: 20-166
agtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgatttgatgagcttccaggttcatgaacacattgaggtgctgggaaggtggtgctcctggaggggacatggaagcctctagcaacctactctcccaggatcaggcccagtgcatctttcccatctggctattcatgagttgtatccttcataacaaaccagtaaatcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagca

SEQ ID NO: 183099 - DNA, 683 bp, Homo sapiens
  Payload ID: 16074
  Gene Symbol: SLC2A11
  Gene Name: solute carrier family 2 (facilitated glucose transporter), member 11
  ENST ID: ENST00000436643
  CDS Start-End: 106-447
gcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaagcctctctttctgtgtgtttcacttcccccaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagg

SEQ ID NO: 183100 - DNA, 742 bp, Homo sapiens
  Payload ID: 16074
  Gene Symbol: SLC2A11
  Gene Name: solute carrier family 2 (facilitated glucose transporter), member 11
  ENST ID: ENST00000423972
  CDS Start-End: 74-391
gcagagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcaggtaagcacccctcccccacatgcattgagtatttcggagataccagtaaaagcgtttcttcacctaaatgtctcccctacccactagtagattaaagcattattgctttgcatgaa

SEQ ID NO: 183101 - DNA, 3264 bp, Homo sapiens
  Payload ID: 16074
  Gene Symbol: SLC2A11
  Gene Name: solute carrier family 2 (facilitated glucose transporter), member 11
  ENST ID: ENST00000618114
  CDS Start-End: 491-2098
atctttcggtctttcctaattttcccgtcctctggggaaaggtcggggatacctgaaccaaagtgtgtgtgtgtgggggggggggggtgtaggtggggcgtgcatagatgtgcacaaccaagggcttggccctccggagaacgcccaggggcagtggcctccgaggttctggcggccggcagtggcgaccggcgcagggaatcgcgcagggttgcggctgaggtcagaccagcgagagacagagacccgcagacatttagtccagagactgtagcaaaggagggggacgaggggccagagccggaatttcgggggaggacttgggagcgcggcgaccagagtcgcttgctggcacttgcgagggcgaatgcaggggcttggccgagatgaccttggaccagagctcccttccggcctgcagagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtagctggggtggatgagggctggggggtccaggccgggctgacttccacctcacccccgccccgtccacggcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggtcttggggtcttttttaatccgcaggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgtgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtc

SEQ ID NO: 183102 - DNA, 2748 bp, Homo sapiens; identical to SEQ ID NO: 183096
  Payload ID: 16074
  Gene Symbol: SLC2A11
  Gene Name: solute carrier family 2 (facilitated glucose transporter), member 11
  ENST ID: ENST00000619667
  CDS Start-End: 218-886

SEQ ID NO: 183103 - DNA, 2388 bp, Homo sapiens; identical to SEQ ID NO: 183094
  Payload ID: 16074
  Gene Symbol: SLC2A11
  Gene Name: solute carrier family 2 (facilitated glucose transporter), member 11
  Uniprot ID: Q9BYW1
  ENST ID: ENST00000619254
  CDS Start-End: 190-1701

SEQ ID NO: 183104 - DNA, 3219 bp, Homo sapiens; identical to SEQ ID NO: 183093
  Payload ID: 16074
  Gene Symbol: SLC2A11
  Gene Name: solute carrier family 2 (facilitated glucose transporter), member 11
  Uniprot ID: Q9BYW1
  ENST ID: ENST00000618502
  CDS Start-End: 269-1759

SEQ ID NO: 183105 - DNA, 3264 bp, Homo sapiens; identical to SEQ ID NO: 183101
  Payload ID: 16074
  Gene Symbol: SLC2A11
  Gene Name: solute carrier family 2 (facilitated glucose transporter), member 11
  ENST ID: ENST00000611880
  CDS Start-End: 491-2098

SEQ ID NO: 183106 - DNA, 1555 bp, Homo sapiens; identical to SEQ ID NO: 183092
  Payload ID: 16074
  Gene Symbol: SLC2A11
  Gene Name: solute carrier family 2 (facilitated glucose transporter), member 11
  Uniprot ID: Q9BYW1
  ENST ID: ENST00000620942
  CDS Start-End: 38-1537

SEQ ID NO: 183107 - DNA, 742 bp, Homo sapiens; identical to SEQ ID NO: 183100
  Payload ID: 16074
  Gene Symbol: SLC2A11
  Gene Name: solute carrier family 2 (facilitated glucose transporter), member 11
  ENST ID: ENST00000625546
  CDS Start-End: 74-391

SEQ ID NO: 183108 - DNA, 730 bp, Homo sapiens; identical to SEQ ID NO: 183095
  Payload ID: 16074
  Gene Symbol: SLC2A11
  Gene Name: solute carrier family 2 (facilitated glucose transporter), member 11
  ENST ID: ENST00000628119
  CDS Start-End: 38-577

SEQ ID NO: 183109 - DNA, 683 bp, Homo sapiens; identical to SEQ ID NO: 183099
  Payload ID: 16074
  Gene Symbol: SLC2A11
  Gene Name: solute carrier family 2 (facilitated glucose transporter), member 11
  ENST ID: ENST00000627257
  CDS Start-End: 106-447

SEQ ID NO: 183110 - DNA, 559 bp, Homo sapiens; identical to SEQ ID NO: 183098
  Payload ID: 16074
  Gene Symbol: SLC2A11
  Gene Name: solute carrier family 2 (facilitated glucose transporter), member 11
  ENST ID: ENST00000630108
  CDS Start-End: 20-166

SEQ ID NO: 183111 - DNA, 1436 bp, Homo sapiens; identical to SEQ ID NO: 183091
  Payload ID: 16074
  Gene Symbol: SLC2A11
  Gene Name: solute carrier family 2 (facilitated glucose transporter), member 11
  ENST ID: ENST00000630215
  CDS Start-End: 15-311

SEQ ID NO: 183112 - DNA, 4468 bp, Homo sapiens
  Payload ID: 16075
  Gene Symbol: SLC2A12
  Gene Name: solute carrier family 2 (facilitated glucose transporter), member 12
  Uniprot ID: Q8TD20
  ENST ID: ENST00000275230
  CDS Start-End: 157-2010
agaaacaaagttggtcacaaatcacattagctttgcccgaagtttttccccacactcttctttagcatgctattatggggaaagtgaccactcctgggagcgggggtggtcggggcggtttggtggcggggaagcggctgtaacttctacgtgaccatggtacctgttgaaaacaccgagggccccagtctgctgaaccagaaggggacagccgtggagacggagggcagcggcagccggcatcctccctgggcgagaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaatggcctcaacaccttctgaacgtggatagtgccagaacacttaggagggtgtctttggaccaatgcatagttgcgactcctgtgctctcttttcagtgtcatggaactggttttgaagagacactctgaaatgataaagacagcctttaatccccctcctccccagaaggaacctcaaaaggtagatgaggtacaaggtcctaagtgatctctttttctgagcaggatatcaggttaaaaaaaaaaagttactggctggtttaatactttctaccttcttcacagagcagcctttgaatagactatgtcctagtgaagacatcaacctccgccttaagctatgtatgtatggaggccagtcgcagctttattatgcagacacacaagtggtctggacatgagggtacagtttctgcctaccaagacactacttgcactggatcttacgcaaaaaagaaccagaacacacagtgtggacaactgcccatatattctatctagattaggagagggtcctggctaggattttagtggtaattcctagttacattcaacaagtataaagattatagagcttattttatgaactataaactataatttaatgcaaaatatccttttatgaatttcatgttaatattgtgaaatattaaaataattccacaatagttgagaaaaatgagcatttttttccatttttaaaaaatgcatagaaaagacaattttaaaatcctgggaccatatttatttagaagtagctgttagtaaaacattagaaaaggagtcaggccattaggttatttatccaaatctctaagcaattaggttgaagttattaagtcaagcctagaaaagctgcctccttgtaaggctttcatgacaatgtatagtaatccacagtgtccaattcttcacactcctcaggaatatcactacctcaggttacggtacacaggctataattgatgatgatgttcagataactgaagacacaataaatgacattcagacatcaggacaattccctcatgttcttttctatgatggccacctgtaccagcaacgtgggtttcacccacacaacgatgaactgttctcttacttctccagttgattttaaagacttgttaagaggtcttactaataaaatttgggtatgatagaaaatccacaatcaaatcttgaaccaaataacatattaaattactaatatttaagtgatggaagacacacaaaaaacttaaaagcacgaacaacctaacttgaaaaagaattttaaaatatgattaacctgaagaaaagagaatcctaagagccaaagctcctttttatttagcttggaattttcctattggttcctaacaaactgtcccaatgtcatataaggaaacatgatctattacattcctttataacaatgtggagagactataaacctatgtaagtagtaaaactatatcagagactcaggagactgactaaaaggcctggatctgcagtgtattatctgtataaaaattggcagggggaagctaaaaggaaaggagattggagatctcaattctatcatggtgtatttcatacgcaaatcagagcatgcattgttttttgtttttggaaagagaagggaagtgtgttctgccccatgtttccttccgtgtttatagttcaaactctatatatacttcaggtattttttgtttagcccttcattataaatgggcaggaaattgtttatcaacctagccagtttattactagtgaccttgacttcagtatcttgagcattcttttatatttttcttttattatcctgagtctgtaactaaacaattttgtcttcaaatttttatccaatatccattgcaccacaccaaatcaagcttcttgattttcaaaaataaaaagggggaaatacttacaacttgtacatatatattcacagtttttatttataaaaaaaatttacagtacttatggagagccagcagaagacatcagagcactcacttcttcccatctttgttaaggttagcgaattacccatggacactgttaggtgaggctcattcggcagccctgaaaacaaacctggtcacactgtctttaccctctcccttcagataaagcacttcgattatctattgatctgcccagttttcaagtcatgcgaatactaaaaaggttacatcatctggatctgtaccttggctatataagcatgttttccccctattctatgtttctttttttggtgaacattgaaaaacaggaggtgacttattactgttaattaaaactaaatgaaaaatgtcaagtctttaaaacagtgagcttgtaactctttcatgtaattttattctctatgaatttggctatcctactgaatcttaaaataaaggaaataaacactttttttttaaaaaaaaggaaaaatacaagtctaaaaatctcaatg

SEQ ID NO: 183113 - DNA, 7003 bp, Homo sapiens
  Payload ID: 16076
  Gene Symbol: SLC2A13
  Gene Name: solute carrier family 2 (facilitated glucose transporter), member 13
  Uniprot ID: Q96QE2
  ENST ID: ENST00000280871
  CDS Start-End: 52-1998
ctgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtactacagtgcaaccattctgcagatgtctggtgttgaagatgatagacttgcaatatggctggcttcagttacagccttcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctacaagatgaacaaatcaactgtcattgactcctcctgtgttccagttaataaagcatctacaaatgaggcagcctggggcaggtgtgaaaatgaaaccaagttcaaaacagaagatatattttgggcttacaatttctgccctactccatactcctggactgcacttctgggccttattttatatcttgtcttctttgcacctggaatgggaccaatgccttggactgtgaattctgaaatatatcccctttgggcaagaagtacaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaaattgaatcactctttgacaacaggctatgtacatgtggcacttcagattctgatgaagggagatatattgaatatattcgggtaaagggaagtaactatcatctttctgacaatgatgcttctgatgtggaataattttcagctgctcatatatttagttatttaaacaaactggggggagaagaacagcaattggtgacttcactgccctgcttctaatctggttctttccacagcctagttttgattgacttcatattctagaatacttgattaggaggaagatacaaccatgatgactttttttttccacaaggaacaatattttaaaaaatatttacagagattttaatctaataattcttaagcaaatgtgtgtaatgccttcctgaaatagtctaaaatgaatattgtacccagtgacttcagtggtatccttttttcctaagaccatttataattattagtggcaacagagtcagtgctaatctagccaaattacatatgtataatatatttataaaggattctgggagatggtccaagggtgttctgtgtcaaaagatggcctattggccctcagttttcctacagagtagtggcttatctctgatcagctgttacaaactaaattccatgtaagctttcatcaacaaattccaaagtgcctcctacaagggcacagctgtccgtatctcctttggattccatatttttgtttctctccaattcagatattgggagttcttcagatactgactctgcacactatcttttgaacattatgaaaatataatctgtcgggttgttttcatacttcttttttttgcatcagtgataaggcatacatttgcgcagatgagctaggaagttttgagaagtaccttttatgttcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactatttcgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtctttttttactttaagagcataaactcgtttttattttgcacacttttctcattttcctgagaatttaccagaaaaaaaaaagatacatagatttgtctctgtgtttttcttattcttggcttagtttttccttcttgtgtaaaaattgagattgcctattggaacagataattggttctaatatagcacgtctataagaaatgcaggcttaattatatttccacaatgtctttccaaggtattcattggtttttatggtaattcatcactgaactcttaatttttgcttttctattaagaactatatagtatgtacaaaattacttgatcacaaaattacttgctagttccaggaaaaatatgaatgaatcttctgtggccagttaggaatacatcagtttgatgcatttttaaatggctctaaacatctaataaggtactgtatttggagagaaaaggtggctatctccatattcaaaatatttcttccagtctccaagatactctattcttttaatgtctggcttgttcctatcacagttatcaagctgagaatacagctgaggaagttcattctctaagtcaccagaggtataatatgtgcttaaactgtcaatttagtgccctaaaaatccattaaccaaaaacaaaaacgttttctccctttggtcatttcatataataaaaaaaattaatattttatagaggttttttccttgaattaggtgctttaacaattgatttccaagggaatattagtattgattttttcctcagaaaagcagatatgatttaatagggaaaattattattctattgatatttcttatctcataagaaatttcttatctaatattttacacaggtaaattgaagtgaaaaataagctactatatggtacaatcaaaatataataaggagaaaaagtagaccaataaagtgctctctaaaaatttattttttggacttaatcaaaataattgcctcaatccttctctttattgtatatgtagccttaactaactatatacttataaactcagctgggctgatgcacagtaactttattaaaggagaaactggactcttgttatttcctaaagcagaacatggcctgttctccctgatataagaaaacaatgttttcaactttataaccataaatgcacataataacagggaaaattagccacagttctcctcccctactcccctgagcccctactttaaaggactatttgttatttatatagtgttaaagataatattccatatctttgaagtataagacagagaggcacagtataagaattatttataactttttagaaacaattacttgaaaaggaaccttatacaattagggtattatttttagatttggtgaacatttatagtatattaaaaattaaatgtttaaattttgcaggtttttttatattaggcaccttttaagttcccagcatatttggctaccactatcaacttggaaacattccatttgtagtatcatcaaatatatattttgtaggacaatttatatatgatgtgatttgacctaccatattaaagcagacacagattacgtatcatgctttcaaccaaaattacagacttcctttgaaacatgctgcagatttgatagaggtatattatgtcttaggaaaatacaatgaagaaggtccaaatccctattgaggctggatgtctgatctgcactagacttaagaggatatatcatttcatctgcatataaacacatagggctgaatgtgatgtcaaaagggtttgccgttaataattttcttcaatgtaaacattcctaataattttgattgttgctccttagtcaatcatttcccaaaacatgattatttttaatatatgtaaaatatttaaataataaataataaaaggtaatgtgtccattttaaattttgttcccagccatacacagtagttccctgatacaaaatgctatgagaataccgactattttttcataatttaattttaccactgaacctgattttagtacataagagtctaaatattaagttattcactctaaaaggggaaatcagtaaaagcaaggaatttatgaaatttttgctgtaatttcagtatctgttatacaggggaagaatgatcaggaaaaatataagctgacaacttacccttttgctttttaacaacaaaataatattgaaaatatattagaataactcacagatccagaagttggtggaaatggaagaatgttttagaaaataccatccatatgtttatctaagaaagtctcagaatttagtgacactaatacagttcataaatactgtaatacagtggagagagttggaatgttattttggttttatttcatcagcacaattattaaaaacaacaaaattaatgagacgttttgttataatcagatttttttttaccatattgcaagttataaaatgtcaacttatactaagtacctaacaactgacttttattcacttgttgtgacaagtttttaattaccaaattaagaccttttcagtatctatgagtaaaagaaatagatgattatatcagaccaggagcagagaatttataatatgtgctttatagcaaaatgtattaaattgtggttaaaatttatagctcatatgtagctgctgccaataagaaggctcagaattgttctgtggattaatttttacatcctgttttctgtcacttttaccaatcttcttggcctcatgtacaataatgtaaagccaatttgatgaaatggttcaggttgtagcagtctataaattgtcggtacattcagctcttctaggtgagcaatactgctgctatttttctagaaatagcaatcatttaaaaatgccaaatagctaactgctaccaactctttcttgtatcttgtctctttagagaaggaaatttttgtgtgccagtaatcatcaaagaggtgttttataagagtgttgatgttcagaagttcatgaaagtattttatccgtataatttgctagtgagctaaaacaatataatttatgtaaatctttatatgtacaaaatatatagtctgttgtacttgagtaatttggtctatggaattttaaatgccttcatttagcagtaatattcacatttttattttagacagttaagttcatgtgtttgattttgtcatgtcagcataaatgagaaaaagaagtggatcatgcagctaatgagtaaccaacattttgtaaagttttaaagttttagcaaacaacattattccatctcatttaaaggttaaaaaagaagagacaactctagccaaagtagaaatttatattctacacgtccaaactgtctcctagcagcttttggactatatatcacttgatgttaaagtatcttttatttgtaataaatattcaaatttctatttagaagctctaatgtatacctagattaaatcaaatcacagttttatgcttttaaaatatatgtatttcaaactgtatattttaatttctgagtgcatgttatatagtatttaatacttcagatgtcttggcaaattcaatataagtatttattcccacaagcgatatatgggatatctcttaaaaattatgaatatgtaccatttccttcaaagtcatcctagcctatgctgtatcaaaagtattgtatattttatggagatttagtgatatacatgtaaatgttttttaagttattttattgaagttcaatctttacataaaattaaaatctttttttaaaaaaagtgtcagtgccagaactgtaaatgaaaataatcaaataaaagttaaaataattcattactcattaa

SEQ ID NO: 183114 - DNA, 3082 bp, Homo sapiens
  Payload ID: 16076
  Gene Symbol: SLC2A13
  Gene Name: solute carrier family 2 (facilitated glucose transporter), member 13
  ENST ID: ENST00000380858
  CDS Start-End: 282-1355
cgcctcccgcccgctccgcagcgccagctcggcaggcgcggggcgtgagtgtggagtgagacccgccgggctccaactccgcagcgtcggagcgcggcgggcagcaactttctccccggagcggccgtggcggcggctgctgccgtggcagccggagcggaagccgggaggaagaaagcggcggcagcggcggttgctcccgccggctcgggctgtctagctcgccgagactgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtatgtatttctttctggctttttactgaaaagattgtgaaaggattattttatgtgaaatagtgaaaagtatttcatgtaaatactagactcagtgatttgttctgattaaatgtatgaattctccttttgggagatactgactttacaattttttaattccagtaatttgttactagataaaggtgatttattttgtttgttatatgattggctttatttgattccataaaatttctcttttacgccatccaatacctccttgtattctgagcttaaatgtgtcattttttctaagccatttcttgatgctggttggaaagcaaaatagaaggaaatcacctggcattgccagagattatgggcacacagataactaattcatttctttttggtgcagtctactacagtgcaatgtgataaggacattagtagaagtacgtttattataaccagagtatggtagaggggagattgagtgggaaggagagtgaggaatacagaaaaattccctgttctctaattttaagagtaattcccaaagctgtatgtgtgctgagggtgggaaggactaaatattaagggctctactaggtttccctcattcagtattaaacccatttttgagggcctctgttgcactagacctacagcagtaactaaaatagacctgggtcttgtcctcatggatgtacaggctggtagaggaagcacacattaaataaactcacagttaaatataagatttcaaactatgataagggccatacaggactctctcaattctctacagagtagacttttaagatcctaaatcataaaatacagtttagagaaggttatgtgctttcccagggcacatattgttagattaaaagctgccacatcttagaagtcctccccactccctgcctattgattgaatttttttcattaagaaaatacaaattatgtaaaattaaattttctttggtaaaccatttgtatttgagactcttgattttttttaattacttgagatatgatgagttatttagtgactgtttgagaagagtgaattgattaaaatatttttaaaaaagaaggattaggacccaatgagccagtatattaaatcaagatttgttgagaaactccattttctatacattcacacactttgtggatttgactttaatcataatccctgttgaacttcaactttcgagactacatgttcaatattttgttctctcctgcttctctctgacattaactttcattttttctcacctttaccagctctattaaggcccatctgttggtctagtgccaggcacgtttgattgcttgttctctgaatttggcacatcatgacttgttctgagatgtgtccaccttctgcagtctggtggaagtatagaattgcagctaggctaggaccaagcatcaaataattaaatccattaataatcctatgtgaattcgttagttgaccaacctaatatttgttctggttttgaaaatatgttttgtttgttatgctttttttcctaagcatttaaacttgacaagtataaaagcatagaaagtgaaggatttttcttgtactttttttgttttcacttaaaactggtatcacaaacagagccaactctagtttatgggtagtgactggggccagtgtattcctagtttgaaatgactgtcataatccattagcagtagctagtgtaaattgagctgattgatgctgtcaaattttaataaaacattcatttctccaaa

SEQ ID NO: 183115 - DNA, 3699 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000340749
  CDS Start-End: 402-1895
gttgagcgaagccgcggggcccaaccgcagtcgcggggtctgggagccctctattggagattctgcctcccctgggacagatggcttcttgagcacactcccacgatgggtggctgctctgggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatgaca

SEQ ID NO: 183116 - DNA, 2335 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000396589
  CDS Start-End: 258-1820
ggacccctgctctgaccgcaggtgggtgcttgtcttgcttacggagggctcccgatgaaccgagtcacgttttgtaaccacattaacggaccattcaaagtcgaatcctaggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttatttttta

SEQ ID NO: 183117 - DNA, 3458 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000431042
  CDS Start-End: 168-1661
agttagtgggtcccaacggctgcaggcggggccggcgggggcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgta

SEQ ID NO: 183118 - DNA, 533 bp, Homo sapiens
  Payload ID: 16077
  Gene Symbol: SLC2A14
  Gene Name: solute carrier family 2 (facilitated glucose transporter), member 14
  ENST ID: ENST00000535266
  CDS Start-End: 174-533
agcagccgccggggctggaccgtgcggtgcgcaggtgagaagccgggaggggccggacaaccccgaccgcgagccggacccctgctctgaccgcaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgatt

SEQ ID NO: 183119 - DNA, 682 bp, Homo sapiens
  Payload ID: 16077
  Gene Symbol: SLC2A14
  Gene Name: solute carrier family 2 (facilitated glucose transporter), member 14
  ENST ID: ENST00000542782
  CDS Start-End: 226-682
tgaccgcaggtgggtgcttgtcttgcttacggagggctcccgatgaaccgagtcacgttttgtaaccacattaacggaccattcaaagtcgaatcctaggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggg

SEQ ID NO: 183120 - DNA, 1650 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000542505
  CDS Start-End: 378-863
gtatctttgaaaatagatacgttcacaccctcctaacggcggcgccaagggtggtgggtcccaaaactgtttccccgtaaagagttcccccgcccggtcgcaggaagacgcctgagggggcgctcggagggatccccagcagccgccggggctggaccgtgcggtgcgcaggtgagaagccgggaggggccggacaaccccgaccgcgagccggacccctgctctgaccgcaggtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaa

SEQ ID NO: 183121 - DNA, 548 bp, Homo sapiens
  Payload ID: 16077
  Gene Symbol: SLC2A14
  Gene Name: solute carrier family 2 (facilitated glucose transporter), member 14
  ENST ID: ENST00000535587
  CDS Start-End: 482-548
gggggcgcagcggcccgggagccctctattggagattctgcctcccctgggacagatggcttcttgagcacactcccacgatgggtggctgctctggtacatctcatccacttcttcatctgtgaagctgtcacccatggtggtgagcagctcctggaggtggtcctcatgaatgaaacctgaggattcctcgttgaagcaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatgtcaccccagctctgatctttgccatcacagttgctacaatcggctctt

SEQ ID NO: 183122 - DNA, 854 bp, Homo sapiens
  Payload ID: 16077
  Gene Symbol: SLC2A14
  Gene Name: solute carrier family 2 (facilitated glucose transporter), member 14
  ENST ID: ENST00000546234
  CDS Start-End: 348-854
gcagcggcccgggaggtgcgtggttgagcgaagccgcggggcccaaccgcagtcgcggggtctgggaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtg

SEQ ID NO: 183123 - DNA, 578 bp, Homo sapiens
  Payload ID: 16077
  Gene Symbol: SLC2A14
  Gene Name: solute carrier family 2 (facilitated glucose transporter), member 14
  ENST ID: ENST00000537557
  CDS Start-End: 155-578
ggcgggggcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttg

SEQ ID NO: 183124 - DNA, 4125 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000543909
  CDS Start-End: 761-2323
agtcgcggggtctgggaggagacctgaatgaaatgagggagccttgggagcatgatccaggcggagggaactggattcgggaggaggaactgccttggccttgaaagatacctaccaggagttcaagtgctgtgcgggtgcatcagctttgtagatttgtgcaagatgaaaattggaattgtcttaggaaattatggatcattcatttattcagtgctggattcattcagtgatttatgtctgaagtgtgacagaaggggagtaaggccaagtgtccttgccctctattggagattctgcctcccctgggacagatggcttcttgagcacactcccacgatgggtggctgctctggtacatctcatccacttcttcatctgtgaagctgtcacccatggtggtgagcagctcctggaggtggtcctcatgaatgaaacctgaggattcctcgttgaagcaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatga

SEQ ID NO: 183125 - DNA, 1732 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000535295
  CDS Start-End: 201-1436
gttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttg

SEQ ID NO: 183126 - DNA, 543 bp, Homo sapiens
  Payload ID: 16077
  Gene Symbol: SLC2A14
  Gene Name: solute carrier family 2 (facilitated glucose transporter), member 14
  ENST ID: ENST00000536594
  CDS Start-End: 113-229
aggtgcgtggttgagcgaagccgcggggcccaaccgcagtcgcggggtctgggaggaagcagtaccttgaagagaaattggagagggagtcaattcctaggatagcagagagatggacaacagacagaatagacagggtctccttgtgtcgcccaggctggtccaaaagggggaaataagaactcctggactcaagcgatcctcccgccttgacctccaaaagtgctgagattacaggcatgagccatcgagcctggcctccgaagccccttctgtatgggtattactccctccatggaggcagagccctcatgactcagtcacttcccaaaaggtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtat

SEQ ID NO: 183127 - DNA, 580 bp, Homo sapiens
  Payload ID: 16077
  Gene Symbol: SLC2A14
  Gene Name: solute carrier family 2 (facilitated glucose transporter), member 14
  ENST ID: ENST00000542916
  CDS Start-End: 328-580
tttggcaggagacctgaatgaaatgagggagccttgggagcatgatccaggcggagggaactggattcgggaggaggaactgccttggccttgaaagatacctaccaggagttcaagtgctgtgcgggtgcatcagctttgtagatttgtgcaagatgaaaattggaattgtcttaggaaattatggatcattcatttattcagtgctggattcattcagtgatttatgtctgaagtgtgacagaaggggagtaaggccaagtgtccttggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactct

SEQ ID NO: 183128 - DNA, 665 bp, Homo sapiens
  Payload ID: 16077
  Gene Symbol: SLC2A14
  Gene Name: solute carrier family 2 (facilitated glucose transporter), member 14
  ENST ID: ENST00000535383
  CDS Start-End: 524-665
tttttagtaaagactgggtttcgccatgttggccaggctggtctcgaacccctgacctcaagttatccgctctcctcggcctccaaaagtgctaggattacaggtgtgagccaccgtgcgcggcccgaaataactctttacaggatctcgccctgggccttcccagcccagccggcccgcccgcggggatagcccgggcactatctccctgctgcaggcggtgaggggctcgggtatctttgaaaatagatacgttcacaccctcctaacggcggcgccaagggtggtgggtcccaaaactgtttccccgtaaagagttcccccgcccggtcgcaggaagacgcctgagggggcgctcggagggatccccagcagccgccggggctggaccgtgcggtgcgcaggtgagaagccgggaggggccggacaaccccgaccgcgagccggacccctgctctgaccgcaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttga

SEQ ID NO: 183129 - DNA, 561 bp, Homo sapiens
  Payload ID: 16077
  Gene Symbol: SLC2A14
  Gene Name: solute carrier family 2 (facilitated glucose transporter), member 14
  ENST ID: ENST00000535344
  CDS Start-End: 139-561
gtgcgccgcgccgtccctgcggccggggggtgcgggaatgaggacctgagctggggtagaggtggccgagctagagtagaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatg

SEQ ID NO: 183130 - DNA, 3120 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000542546
  CDS Start-End: 82-1317
aggtcaccccagctctgatctttgccatcacagttgctacaatcggctctttccagtttggctacaacactggggtcatcaatgctcctgagacggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatgac

SEQ ID NO: 183131 - DNA, 440 bp, Homo sapiens
  Payload ID: 16077
  Gene Symbol: SLC2A14
  Gene Name: solute carrier family 2 (facilitated glucose transporter), member 14
  ENST ID: ENST00000539234
  CDS Start-End: 402-440
gttgagcgaagccgcggggcccaaccgcagtcgcggggtctgggagccctctattggagattctgcctcccctgggacagatggcttcttgagcacactcccacgatgggtggctgctctgggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggaagcagtaccttgaagagaaattggagagggagtcaattcctaggatagcagagagatggacaacagacagaatagatggagtttcacaatggtg

SEQ ID NO: 183132 - DNA, 1873 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000539924
  CDS Start-End: 22-1629
acaacctgacttttgttcacaatgcaaagactccaactgttgagagtagaagtactcctgggtgtgaaacaaggagatgaaatgcggcatttctttttttcttctcagacctccactctggagaagagtcagaatgggggcgtcggggaggaggtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttca

SEQ ID NO: 183133 - DNA, 3366 bp, Homo sapiens
  Payload ID: 16077
  Gene Symbol: SLC2A14
  Gene Name: solute carrier family 2 (facilitated glucose transporter), member 14
  Uniprot ID: Q8TDB8
  ENST ID: ENST00000616981
  CDS Start-End: 1-1563
atggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgtacatgac

SEQ ID NO: 183134 - DNA, 3210 bp, Homo sapiens
  Payload ID: 16078
  Gene Symbol: SLC2A2
  Gene Name: solute carrier family 2 (facilitated glucose transporter), member 2
  Uniprot ID: P11168
  ENST ID: ENST00000314251
  CDS Start-End: 81-1655
aataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttc

SEQ ID NO: 183135 - DNA, 1533 bp, Homo sapiens
  Payload ID: 16078
  Gene Symbol: SLC2A2
  Gene Name: solute carrier family 2 (facilitated glucose transporter), member 2
  ENST ID: ENST00000469787
  CDS Start-End: 74-343
aggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattacca

SEQ ID NO: 183136 - DNA, 2583 bp, Homo sapiens
  Payload ID: 16078
  Gene Symbol: SLC2A2
  Gene Name: solute carrier family 2 (facilitated glucose transporter), member 2
  ENST ID: ENST00000497642
  CDS Start-End: 51-458
gtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcc

SEQ ID NO: 183137 - DNA, 425 bp, Homo sapiens
  Payload ID: 16078
  Gene Symbol: SLC2A2
  Gene Name: solute carrier family 2 (facilitated glucose transporter), member 2
  ENST ID: ENST00000461867
  CDS Start-End: 117-425
gtcactgggaccctggttttcactgtcatcactgctgtgctgggttccttccagtttggatatgacattggtgtgatcaatgcacctcaacagggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatg

SEQ ID NO: 183138 - DNA, 3915 bp, Homo sapiens
  Payload ID: 16079
  Gene Symbol: SLC2A3
  Gene Name: solute carrier family 2 (facilitated glucose transporter), member 3
  Uniprot ID: P11169
  ENST ID: ENST00000075120
  CDS Start-End: 242-1732
gtggggtggggtggggctgggggcttgtcgccctttcaggctccaccctttgcggagattataaatagtcatgatcccagcgagacccagagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttaactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacga

SEQ ID NO: 183139 - DNA, 577 bp, Homo sapiens
  Payload ID: 16079
  Gene Symbol: SLC2A3
  Gene Name: solute carrier family 2 (facilitated glucose transporter), member 3
  ENST ID: ENST00000544291
  CDS Start-End: 153-577
gagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttgg

SEQ ID NO: 183140 - DNA, 589 bp, Homo sapiens
  Payload ID: 16079
  Gene Symbol: SLC2A3
  Gene Name: solute carrier family 2 (facilitated glucose transporter), member 3
  ENST ID: ENST00000544936
  CDS Start-End: 154-300
agagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagtctgttcttccaccaacccttttattttgcagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcac

SEQ ID NO: 183141 - DNA, 3426 bp, Homo sapiens
  Payload ID: 16080
  Gene Symbol: SLC2A4
  Gene Name: solute carrier family 2 (facilitated glucose transporter), member 4
  Uniprot ID: P14672
  ENST ID: ENST00000317370
  CDS Start-End: 269-1798
gtgaagggcgtggcccgcgggggcaggagcgaggtggcgggggcttctcgcgtcttttcccccagccccgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatcccctttcctccccaccttccccagactcagctccagaataccttcttcgctgctagagaagggggattggagggaagacaggtctagactttctcagtgggacaaaccagagcagagagcaggacaggagacaagaaatccagtttcccaccaccttggactcctcccacaatctgggactttcactgaattcttgccacgcagactctgggcaaaggggtttttttttttttttttttttttttttttgagacagtctcgctctgtcgcccaggctcgagtgcagtggcgtgatcttgcttcactgcaagctgtctcccaggttcacgccattctcctgcctcagcctccggagtagctgggactacaggcgcatgccaccacacctggctaatttattttgtatttttagtatatacgcggtttcaccatgttagccagaatggtctcgatctcctgacctcgtgatctgcctgcctcagcctcccaaagtgctgggattacaggcgtgagccaccgcgcctggcgaagggagttctctcttgacccctgcagggaaaaggactcacctccctcactgcaggctcagccttccagggcaagagggaacaggaaagtatgtgcccatgtgtggcaagatggaaggacggcaggctcccgcctctaggcttggggctctaccccgatggtttcccaaggctgccaagaaggagccctaactttcttcctctcccttcctggaagggtgctgcatccacaggcttttgaccaactaaggcaaagaggggatttgaaaggctgcctggaaacactgggctgggaggagcctttggatatttttatatacgtttgaaaaggggattgagagaagaaaccaaaggtcggttgtactaaatgtatatatatagatacttctataaagtcactgctgaagacaagcatcctattgtggaggtacttgaggatgggctgagacagggaccataactcttcacccctcttcctccctctgtcctgcctcagctcaaggcctcagaatcttctggatgccattgctcatgcccctactcacatttctactcgttgctttattaatagtaaatgctcaataaattgtagctgccagtgccgggcattgctcttggcatttgcagaatactcactctgtgagggaggtgtcagcccatgtcacagatgggcagtgaaacccatgataggggcactcttcaccagggacacagctggagacatggcagcaaggatgccaggccctgcccacggccccacatcccctcctccccaccttcaacagtgagttactagcgattctccaaaacagaagagatggagaccaagaccaca

SEQ ID NO: 183142 - DNA, 1852 bp, Homo sapiens
  Payload ID: 16080
  Gene Symbol: SLC2A4
  Gene Name: solute carrier family 2 (facilitated glucose transporter), member 4
  ENST ID: ENST00000424875
  CDS Start-End: 298-1653
gattccaatcctaccaaaaggcagagtgggtctggagggcctttcggggcacaggcagcaagtggattctgcgagccagggttcacccccttgcctagtaggcggcgcggcgctccggaatcggggacaccctgccctcgatccgactcgggaaagcagatccaggcgggtcttgccctccgggagctgtccgtccgtcttcgctcacgggcagtgtttcgaggaccggaggctctccgtgggcccccacccccactcctggccgccctccaggacgctgaactttcccttggccccatggatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaagggagctgacctagattggatagtaactgaggtgtctgaaacgcaccagtggcataacttaccttactccaagaataaaatgatacactttgcattaatact

SEQ ID NO: 183143 - DNA, 1813 bp, Homo sapiens
  Payload ID: 16080
  Gene Symbol: SLC2A4
  Gene Name: solute carrier family 2 (facilitated glucose transporter), member 4
  ENST ID: ENST00000570783
  CDS Start-End: 128-787
gccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatccccttt

SEQ ID NO: 183144 - DNA, 1768 bp, Homo sapiens
  Payload ID: 16080
  Gene Symbol: SLC2A4
  Gene Name: solute carrier family 2 (facilitated glucose transporter), member 4
  ENST ID: ENST00000571308
  CDS Start-End: 200-1585
gctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaagggagctgacctagattggatagtaactgaggtgtctgaaacgcaccagtggcataacttaccttactccaagaataaaatgatac

SEQ ID NO: 183145 - DNA, 2995 bp, Homo sapiens
  Payload ID: 16080
  Gene Symbol: SLC2A4
  Gene Name: solute carrier family 2 (facilitated glucose transporter), member 4
  Uniprot ID: P14672
  ENST ID: ENST00000572485
  CDS Start-End: 201-1448
cgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtaactgctcacctctggaatggcccgagccactggcttcacctccctgggtgtcccggaggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatcccctttcctccccaccttccccagactcagctccagaataccttcttcgctgctagagaagggggattggagggaagacaggtctagactttctcagtgggacaaaccagagcagagagcaggacaggagacaagaaatccagtttcccaccaccttggactcctcccacaatctgggactttcactgaattcttgccacgcagactctgggcaaaggggtttttttttttttttttttttttttttttgagacagtctcgctctgtcgcccaggctcgagtgcagtggcgtgatcttgcttcactgcaagctgtctcccaggttcacgccattctcctgcctcagcctccggagtagctgggactacaggcgcatgccaccacacctggctaatttattttgtatttttagtatatacgcggtttcaccatgttagccagaatggtctcgatctcctgacctcgtgatctgcctgcctcagcctcccaaagtgctgggattacaggcgtgagccaccgcgcctggcgaagggagttctctcttgacccctgcagggaaaaggactcacctccctcactgcaggctcagccttccagggcaagagggaacaggaaagtatgtgcccatgtgtggcaagatggaaggacggcaggctcccgcctctaggcttggggctctaccccgatggtttcccaaggctgccaagaaggagccctaactttcttcctctcccttcctggaagggtgctgcatccacaggcttttgaccaactaaggcaaagaggggatttgaaaggctgcctggaaacactgggctgggaggagcctttggatatttttatatacgtttgaaaaggggattgagagaagaaaccaaaggtcggttgtactaaatgtatatatatagatacttctataaagtcactgctgaagacaa

SEQ ID NO: 183146 - DNA, 2301 bp, Homo sapiens
  Payload ID: 16081
  Gene Symbol: SLC2A6
  Gene Name: solute carrier family 2 (facilitated glucose transporter), member 6
  Uniprot ID: Q9UGQ3
  ENST ID: ENST00000371897
  CDS Start-End: 38-1375
ctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcaggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacctgt

SEQ ID NO: 183147 - DNA, 2528 bp, Homo sapiens
  Payload ID: 16081
  Gene Symbol: SLC2A6
  Gene Name: solute carrier family 2 (facilitated glucose transporter), member 6
  Uniprot ID: Q9UGQ3
  ENST ID: ENST00000371899
  CDS Start-End: 79-1602
cggtgccctcggagctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacctgt

SEQ ID NO: 183148 - DNA, 588 bp, Homo sapiens
  Payload ID: 16081
  Gene Symbol: SLC2A6
  Gene Name: solute carrier family 2 (facilitated glucose transporter), member 6
  ENST ID: ENST00000414172
  CDS Start-End: 151-588
cgagagagacccggccatgcaggagccgctgctgggagccgagggcccggactacgacaccttccccgagaagccgcccccgtcgccaggggacagggcgcgggtcggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggggctgactctcccatctcggccgggcctaggaaccagtattttcagcaaaacctggtgcggcggctgtgtcttgcaggtgtacgtgtctgagattgctcccccaggcgttcgtggggctctgggggccacaccccagctcatggcagtgttcggatccctgtccctctacgcccttggcaaggacgaagaggccctgcgggcgctggcctggctgcgtgggacggacgtcgatgtccactgggagttcgagcagatccaggacaacgtccgg

SEQ ID NO: 183149 - DNA, 727 bp, Homo sapiens
  Payload ID: 16081
  Gene Symbol: SLC2A6
  Gene Name: solute carrier family 2 (facilitated glucose transporter), member 6
  ENST ID: ENST00000432868
  CDS Start-End: 69-727
ggagctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttgggacgaagaggccctgcgggcgctggcctggctgcgtgggacggacgtcgatgtccactgggagttcgagcagatccaggacaacgtccggagacag

SEQ ID NO: 183150 - DNA, 2301 bp, Homo sapiens; identical to SEQ ID NO: 183146
  Payload ID: 16081
  Gene Symbol: SLC2A6
  Gene Name: Solute carrier family 2 (facilitated glucose transporter), member 6
  ENST ID: ENST00000625425
  CDS Start-End: 38-1375

SEQ ID NO: 183151 - DNA, 727 bp, Homo sapiens; identical to SEQ ID NO: 183149
  Payload ID: 16081
  Gene Symbol: SLC2A6
  Gene Name: Solute carrier family 2 (facilitated glucose transporter), member 6
  ENST ID: ENST00000625489
  CDS Start-End: 69-727

SEQ ID NO: 183152 - DNA, 2528 bp, Homo sapiens; identical to SEQ ID NO: 183147
  Payload ID: 16081
  Gene Symbol: SLC2A6
  Gene Name: Solute carrier family 2 (facilitated glucose transporter), member 6
  ENST ID: ENST00000626271
  CDS Start-End: 79-1602

SEQ ID NO: 183153 - DNA, 588 bp, Homo sapiens; identical to SEQ ID NO: 183148
  Payload ID: 16081
  Gene Symbol: SLC2A6
  Gene Name: Solute carrier family 2 (facilitated glucose transporter), member 6
  ENST ID: ENST00000627959
  CDS Start-End: 151-588

SEQ ID NO: 183154 - DNA, 1539 bp, Homo sapiens
  Payload ID: 16082
  Gene Symbol: SLC2A7
  Gene Name: solute carrier family 2 (facilitated glucose transporter), member 7
  Uniprot ID: Q6PXP3
  ENST ID: ENST00000400906
  CDS Start-End: 1-1539
atggagaacaaagaggcgggaacccctccacccattccatccagggaggggcggctccagccgacgctgttgctggcgacactgagcgcggcctttggctcagccttccagtacggctacaacctctctgtggtcaacacgccgcacaaggtcttcaagtcattttacaacgaaacctactttgagcgacacgcaacattcatggacgggaagctcatgctgcttctatggtcttgcaccgtctccatgtttcctctgggcggcctgttggggtcattgctcgtgggcctgctggttgatagctgcggcagaaaggggaccctgctgatcaacaacatctttgccatcatccccgccatcctgatgggagtcagcaaagtggccaaggcttttgagctgatcgtcttttcccgagtggtgctgggagtctgtgcaggcatctcctacagcgcccttcccatgtacctgggagaactggcccccaagaacctgagaggcatggtgggaacaatgaccgaggttttcgtcatcgttggagtcttcctagcacagatcttcagcctccaggccatcttgggcaacccggcaggctggccggtgcttctggcgctcacaggggtgcccgccctgctgcagctgctgaccctgcccttcttccccgaaagcccccgctactccctgattcagaaaggagatgaagccacagcgcgacaagctctgaggaggctgagaggccacacggacatggaggccgagctggaggacatgcgtgcggaggcccgggccgagcgcgccgagggccacctgtctgtgctgcacctctgtgccctgcggtccctgcgctggcagctcctctccatcatcgtgctcatggccggccagcagctgtcgggcatcaatgcgatcaactactatgcggacaccatctacacatctgcgggcgtggaggccgctcactcccaatatgtaacggtgggctctggcgtcgtcaacatagtgatgaccatcacctcggctgtccttgtggagcggctgggacggcggcacctcctgctggccggctacggcatctgcggctctgcctgcctggtgctgacggtggtgctcctattccagaacagggtccccgagctgtcctacctcggcatcatctgtgtctttgcctacatcgcgggacattccattgggcccagtcctgtcccctcggtggtgaggaccgagatcttcctgcagtcctcccggcgggcagctttcatggtggacggggcagtgcactggctcaccaacttcatcataggcttcctgttcccatccatccaggaggccatcggtgcctacagtttcatcatctttgccggaatctgcctcctcactgcgatttacatctacgtggttattccggagaccaagggcaaaacatttgtggagataaaccgcatttttgccaagagaaacagggtgaagcttccagaggagaaagaagaaaccattgatgctgggcctcccacagcctctcctgccaaggaaacttccttttag

SEQ ID NO: 183155 - DNA, 914 bp, Homo sapiens
  Payload ID: 16083
  Gene Symbol: SLC2A8
  Gene Name: solute carrier family 2 (facilitated glucose transporter), member 8
  ENST ID: ENST00000373352
  CDS Start-End: 228-872
ccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagc

SEQ ID NO: 183156 - DNA, 1937 bp, Homo sapiens
  Payload ID: 16083
  Gene Symbol: SLC2A8
  Gene Name: solute carrier family 2 (facilitated glucose transporter), member 8
  ENST ID: ENST00000373360
  CDS Start-End: 1-1236
atgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaacaaaaaaaaa

SEQ ID NO: 183157 - DNA, 2172 bp, Homo sapiens
  Payload ID: 16083
  Gene Symbol: SLC2A8
  Gene Name: solute carrier family 2 (facilitated glucose transporter), member 8
  Uniprot ID: Q9NY64
  ENST ID: ENST00000373371
  CDS Start-End: 90-1523
attggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagtttaaaaaataaacagcaaaaaaaaacaaaacaaaacaaaaaaaaa

SEQ ID NO: 183158 - DNA, 933 bp, Homo sapiens
  Payload ID: 16083
  Gene Symbol: SLC2A8
  Gene Name: solute carrier family 2 (facilitated glucose transporter), member 8
  ENST ID: ENST00000423934
  CDS Start-End: 132-933
caggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctc

SEQ ID NO: 183159 - DNA, 1030 bp, Homo sapiens
  Payload ID: 16083
  Gene Symbol: SLC2A8
  Gene Name: solute carrier family 2 (facilitated glucose transporter), member 8
  ENST ID: ENST00000430147
  CDS Start-End: 1-831
cagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatgctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaaga

SEQ ID NO: 183160 - DNA, 992 bp, Homo sapiens
  Payload ID: 16083
  Gene Symbol: SLC2A8
  Gene Name: solute carrier family 2 (facilitated glucose transporter), member 8
  ENST ID: ENST00000451404
  CDS Start-End: 196-992
ggccggtgcgggccgcactcgcagggcccgtggcggttcaggcgccagagctggccgatcggcgttggccgccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcag

SEQ ID NO: 183161 - DNA, 854 bp, Homo sapiens
  Payload ID: 16083
  Gene Symbol: SLC2A8
  Gene Name: solute carrier family 2 (facilitated glucose transporter), member 8
  ENST ID: ENST00000439597
  CDS Start-End: 132-854
caggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccct

SEQ ID NO: 183162 - DNA, 793 bp, Homo sapiens
  Payload ID: 16083
  Gene Symbol: SLC2A8
  Gene Name: solute carrier family 2 (facilitated glucose transporter), member 8
  ENST ID: ENST00000419917
  CDS Start-End: 25-793
ggccgatcggcgttggccgccgacatgacgcccgaggacccagaggaaacccagccgcttctggggcctcctggcggcagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcag

SEQ ID NO: 183163 - DNA, 506 bp, Homo sapiens
  Payload ID: 16083
  Gene Symbol: SLC2A8
  Gene Name: solute carrier family 2 (facilitated glucose transporter), member 8
  ENST ID: ENST00000419132
  CDS Start-End: 1-506
gcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagcagctgtcgggggtcaacgccgtcatgttctatgcagagaccatctttgaagag

SEQ ID NO: 183164 - DNA, 1763 bp, Homo sapiens
  Payload ID: 16083
  Gene Symbol: SLC2A8
  Gene Name: solute carrier family 2 (facilitated glucose transporter), member 8
  ENST ID: ENST00000610552
  CDS Start-End: 213-1157
gcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggacagcagcctggcctcggtcgtcgtgggtgtcatccaggtgctgttcacagctgtggcggctctcatcatggacagagcagggcggaggctgctcctggtcttgtcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttctgtgtccctgaaactaaaggaaagactctggaacaaatcacagcccattttgaggggcgatgacagccactcactaggggatggagcaagcctgtgactccaagctgggcccaagcccagagcccctgcctgccccaggggagccagaatccagccccttggagccttggtctgcagggtccctccttcctgtcatgctccctccagcccatgacccggggctaggaggctcactgcctcctgttccagctcctgctgctgctctgaggactcaggaacaccttcgagctttgcagacctgcggtcagccctccatgcgcaagactaaagcagcggaagaggaggtgggcctctaggatctttgtcttctggctggaggtgcttttggaggttgggtgctgggcattcagtcgctcctctcacgcggctgccttatcgggaaggaaatttgtttgccaaataaagactgacacagaaaatcaggtcagtgtctctgggctttgtgcaagctcagtttgaaaagggtttattcccatcactgcccaggacaccctgtggctttacttgctcatggtcagccaagcttacccttcacactgagaagtcatttctggctacttccttgggctcagttccctgggtcatcagccatcaaatcttgttgagttt

SEQ ID NO: 183165 - DNA, 1850 bp, Homo sapiens
  Payload ID: 16084
  Gene Symbol: SLC2A9
  Gene Name: solute carrier family 2 (facilitated glucose transporter), member 9
  Uniprot ID: Q9NRM0
  ENST ID: ENST00000264784
  CDS Start-End: 55-1677
cttggcagagtctggggtccctggactgagccatcagctgggtcactgagacccatggcaaggaaacaaaataggaattccaaggaactgggcctagttcccctcacagatgacaccagccacgccgggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaa

SEQ ID NO: 183166 - DNA, 1866 bp, Homo sapiens
  Payload ID: 16084
  Gene Symbol: SLC2A9
  Gene Name: solute carrier family 2 (facilitated glucose transporter), member 9
  Uniprot ID: Q9NRM0
  ENST ID: ENST00000309065
  CDS Start-End: 160-1695
gttggctctagggctggcaccaggcactggaattaaacattctggactccagaggggcatgaaaactcttcctgaaggagatgcagaggaagattcgaactggaggaaaaccctaaaataaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatct

SEQ ID NO: 183167 - DNA, 1927 bp, Homo sapiens
  Payload ID: 16084
  Gene Symbol: SLC2A9
  Gene Name: solute carrier family 2 (facilitated glucose transporter), member 9
  Uniprot ID: Q9NRM0
  ENST ID: ENST00000506583
  CDS Start-End: 219-1754
ccatgaagagttctagcaccaagtcagtgcaagacccgaggtgttcctgttggctgagtgttggctctagggctggcaccaggcactggaattaaacattctggactccagaggggcatgaaaactcttcctgaaggagatgcagaggaagattcgaactggaggaaaaccctaaaataaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaa

SEQ ID NO: 183168 - DNA, 738 bp, Homo sapiens
  Payload ID: 16084
  Gene Symbol: SLC2A9
  Gene Name: solute carrier family 2 (facilitated glucose transporter), member 9
  ENST ID: ENST00000513129
  CDS Start-End: 145-738
catggacatgaatgtgtggcttaaattacattgctgtgtgggcatgaatcagacgctctgcccatgaagagttctagcaccaagtcagtgcaagacccgaggtgaaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaag

SEQ ID NO: 183169 - DNA, 2344 bp, Homo sapiens
  Payload ID: 16085
  Gene Symbol: SLC2A5
  Gene Name: solute carrier family 2 (facilitated glucose/fructose transporter), member 5
  Uniprot ID: P22732
  ENST ID: ENST00000377414
  CDS Start-End: 69-803
ctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggtgagttcaggacatctcgggagcacccccaccccttcaccactacccttggccccctccttgtgttccaaagccaccaccacaggacaggactttctgcagactggtctcttctaacaggctggatgtccttggggggcccatcctgtcccgagccaacatagcaggccatggacaaaggcgcgataagggactggccagcgtttactatctagtccctcttaggagatggatgaggtggctttgagtgatgggcttccctgcctgctcagcagctgtccatatggaggcccgtggcatagcaatgacagccaccagtgtgccaggctctgtgcttggggcggacccagcatcagttcataggaccctcccagcaacgctgctgcctgggactcagtgattatcccattttgcagaccagaaagagaagtaccaggagtgagggtggcctggccccatgggggaggtggtgaggacatcccagaccctgcctccaccttccccaagacagcctggggcctggcatgcggcaggtgcacagacacctgtaaccggggttgtttttgcacgactttccctttaaactatcatcagtcatcccgtcagccaaaacataagccagttcccgccagggttctacacaccgtctgcaagtcagtcaagtggatcatcaagctctgtgctgcttagacactctctgtagaaagtgcttaccgtgagccaagtgccaagtcttttttagtaactcatgtattcctcagaacagccctattaagcctgtaccagtatcatacccattttgcaggtgcatcacaggtacagagagattggaagactggtccaaggtctcatgaggatgcagacccagcggcacagacctaggtccctgtttaagtaccacatgctcctgcctctccttcactcctgcatgtgttggggacacttacgccaaggcgccgcgttctcattaggagctgggaccagaagtgaataagccaggttcctgtctcagggagctccatagcaggactcagaaccacacacggccctctaggcatttgtgaagctctgtgcttcatttttttgctttgcctctagttttgcctttgcagtaccaatgcagccagcccatgtgtcccctctatgtggaatgttaacgatattcccactgtttctggtgtcctttctgtaatcagagctgccgtgaccattccagttcaggcatcctggtggcctggcttctctgggcatagagctgggagtgggcagttgggtcaggccgggtatgcccagctcctccagcccctgcaagactgtcctctgaaggacacggggacgttctcaccagcacatggtattaccggcctcgtcggtgtggtctgtctgatgggcgcaggggtgcgtcgctgctgatccctgctgcaggtgtttcccgagtgtccaccgtcgggagttgctgttcttagggctgggaaagctgtgccctcctggagcctgcaccccactcaggatgacggggctggggccggctctgcagagggcgccttcggggtggtggggaggccgctggtgccagctcgctgccttcctcccaggctggccgatcctgctggggctgaccggggtccccgcggcgctgcagctccttctgctgcccttcttccccgagagccccaggtacctgctgattcagaagaaagacgaa

SEQ ID NO: 183170 - DNA, 4165 bp, Homo sapiens
  Payload ID: 16085
  Gene Symbol: SLC2A5
  Gene Name: solute carrier family 2 (facilitated glucose/fructose transporter), member 5
  Uniprot ID: P22732
  ENST ID: ENST00000377424
  CDS Start-End: 181-1686
gaagtgaaaggaagaccaggttcctgaaagggttattctgacttaatctggctataaaaatgctattggctgttatttggcatggccaaagtgcacccagaatgtcttctctctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaacttggtggccccgacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttcaacaagacgtgctgctgttctttgagcaagtagaaggcaggaggaagttccctgctcattcaggcagtgttttttttgtttttatttttgcttttttttttttttttaagacggagtctcgctctgtcacccaggctggagtgcagtggtgcgatctcagctcactgcaaactccacctcccgggttcacaccattctcctgcctcagcctcctgagtagctgggactacaggcgcctgccaccacgcccggctaacttttttgtatttttagtagagactgggtttcactgtgttggccaggatagtctcaatctcctgacctcatgatccgcccacctaggcccctcaaagtgctgggattacaggtgtgagccactgcgcccggccacttcaggcagtttgactgcacgagtgtcagttccttgagggcaggggcttggtcagttttgtttatgcctgaatccccagcatctcgaagagggcctctggaggctgaggtgggaggattgcttaagcctgggaagtagaggttgcagtgagctgaaattgcaccctatactccagcctgggcaacacagtgagatcccatctcaaaaaaaatttttttaattgggcatggtgacacgcctttggggtcccagctatttgggaggctgaaatgggaggatcgcttgagcctgggaggtcaaggctgccctgagtcatgattgcatcactgcacaccagcctgcatgacagaatgagaccttgtctcaaataaataaatacatgtaagattgaggaagcttccaaatgtcctcacatatgtaatgaaatcttgaggagtcttaaaatcttgagactgtggtgggggaggaagggaaaaggaacagggtcttgatatggtttggctgtgtccccacccaaatctcatcttgaattgtagctcccataattcccatgtgttctgggagggaccctgtgggagataattgaatcatgggggcaatttcccccatactgttctcatggtagtgaatcagcctcatgagatctgatggttctgtaaggggtaaaaccttttgcttggttctcattctctcttgcctgccaccaggtaagacgtgccttttgctttctggcatgattgtgaggcctccccagccatgtggaatggcgagtccattaaatctctttttctttgcaatttacccagtctctgatacatctttatcagcagcatgaaaatggtctaacacaggtctctccccaaaaatatagagagctggaggtttttcttagagatatgaataaagggtgtgagtgtgagtgtatgtgcaaaaatatggataaaaccttgaaagtgctgaatggcctgtagcaagaagtgatgtcttctcatagatgggtggcagaggctggtggccgggagagagagcagtgggacttgggagcactttttgtgggtatgtaatggagattccaccagcaacaagctaaaccactcacaagcgggcccagaggaagtaaacagaacactgtggttgaaccatccttggccttctgcagcaaggatctgcagcctggaaggggcacagaaacaaccaaagatgaaggctctcagagctgaggagaggccaggtcagaatatcagaagtcaagaaactgcagcacctctaacacaggggaggctatgaagttcatggttctggatgtctgctccctgggttcaaaccttggtcctgccacattagttgtgcaacttggaaagttacttggcttttttgtatctcagtcttctcttctgttaaatggcactaatagtaaatgtctcacatgtccattgtgagaattaaatga

SEQ ID NO: 183171 - DNA, 846 bp, Homo sapiens
  Payload ID: 16085
  Gene Symbol: SLC2A5
  Gene Name: solute carrier family 2 (facilitated glucose/fructose transporter), member 5
  ENST ID: ENST00000474145
  CDS Start-End: 276-846
accgctgccatccccctcctccatctttgagccactaggcttctcacagtctcccaccccgccctgctcgcggagcctgcaggcctcggcctcatggcggcctgaggcaggggcctggaggctggtccgcccgccacgaaggttggggggtccctggccagaagcaggacccgggcgaggctgagggggactctggcagaagctgaaggggacccggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatg

SEQ ID NO: 183172 - DNA, 455 bp, Homo sapiens
  Payload ID: 16085
  Gene Symbol: SLC2A5
  Gene Name: solute carrier family 2 (facilitated glucose/fructose transporter), member 5
  ENST ID: ENST00000473209
  CDS Start-End: 213-455
accatgagcctgactggtagagactttagcaatggggaaataccgtagactgttccatcaggacaatgctgggcctgcagtccccagggggcacccacttacttagccaaaccccagacgtttcatttaaaagcagaagtgaaaggaagaccagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttgga

SEQ ID NO: 183173 - DNA, 755 bp, Homo sapiens
  Payload ID: 16085
  Gene Symbol: SLC2A5
  Gene Name: solute carrier family 2 (facilitated glucose/fructose transporter), member 5
  ENST ID: ENST00000487835
  CDS Start-End: 258-755
agtggcagttggccagatgccgaaccaccaccaggggtggttggcaaactgcagccacccaaggggctggagtagttttcaaacaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccc

SEQ ID NO: 183174 - DNA, 889 bp, Homo sapiens
  Payload ID: 16085
  Gene Symbol: SLC2A5
  Gene Name: solute carrier family 2 (facilitated glucose/fructose transporter), member 5
  ENST ID: ENST00000486632
  CDS Start-End: 319-889
cgggtgaagaatgtgggggagagtggcagttggccagatgccgaaccaccaccaggggtggttggcaaactgcagccacccaaggggctggagtagttttcaaacagtttgactcttttcatcaacaccagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatg

SEQ ID NO: 183175 - DNA, 684 bp, Homo sapiens
  Payload ID: 16085
  Gene Symbol: SLC2A5
  Gene Name: solute carrier family 2 (facilitated glucose/fructose transporter), member 5
  ENST ID: ENST00000484798
  CDS Start-End: 114-684
agcgttggtgacgccatggctgtgcttgcgacgccctgtcactggcaggaaccggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatg

SEQ ID NO: 183176 - DNA, 676 bp, Homo sapiens
  Payload ID: 16085
  Gene Symbol: SLC2A5
  Gene Name: solute carrier family 2 (facilitated glucose/fructose transporter), member 5
  ENST ID: ENST00000464985
  CDS Start-End: 260-676
agatgccgaaccaccaccaggggtggttggcaaactgcagccacccaaggggctggagtagttttcaaacagcaccacattatcccaggaggaaaagcagacgcgtgacagagtcagagagcaggcatagagtgctgtggcagtcagccagtgcccacatcaacaccaaggagagtcctgcgggtgctgtgcaaggccgggtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgca

SEQ ID NO: 183177 - DNA, 758 bp, Homo sapiens
  Payload ID: 16085
  Gene Symbol: SLC2A5
  Gene Name: solute carrier family 2 (facilitated glucose/fructose transporter), member 5
  ENST ID: ENST00000479813
  CDS Start-End: 188-758
attgtctggtcacagaacagcccggagatgtgccagcttgctttgtgggacagggtcttgctctgtcacctaggctggagtgcagtggcatgatcgaattcctgggctcaagcgatcctcttgcctcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatg

SEQ ID NO: 183178 - DNA, 3381 bp, Homo sapiens
  Payload ID: 16086
  Gene Symbol: SLC20A1
  Gene Name: solute carrier family 20 (phosphate transporter), member 1
  Uniprot ID: Q8WUM9
  ENST ID: ENST00000272542
  CDS Start-End: 540-2579
gcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgtcgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatt

SEQ ID NO: 183179 - DNA, 638 bp, Homo sapiens
  Payload ID: 16086
  Gene Symbol: SLC20A1
  Gene Name: solute carrier family 20 (phosphate transporter), member 1
  ENST ID: ENST00000433924
  CDS Start-End: 1-638
tttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctc

SEQ ID NO: 183180 - DNA, 668 bp, Homo sapiens
  Payload ID: 16086
  Gene Symbol: SLC20A1
  Gene Name: solute carrier family 20 (phosphate transporter), member 1
  ENST ID: ENST00000423633
  CDS Start-End: 1-269
ctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgtggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaaataatttgtgagaatataaaggttgaaatgtt

SEQ ID NO: 183181 - DNA, 574 bp, Homo sapiens
  Payload ID: 16086
  Gene Symbol: SLC20A1
  Gene Name: solute carrier family 20 (phosphate transporter), member 1
  ENST ID: ENST00000456264
  CDS Start-End: 1-296
tattcttcctggttcgtgcattcatcctccataaggcagatccagttcctaatggtttgcgagctttgccagttttctatgcctgcacagttggaataaacctcttttccatcatgtatactggagcaccgtggctgaaatctcctagaaggtggctggcctgcgcccatttcagaaggctgcaggctagttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcacc

SEQ ID NO: 183182 - DNA, 584 bp, Homo sapiens
  Payload ID: 16086
  Gene Symbol: SLC20A1
  Gene Name: solute carrier family 20 (phosphate transporter), member 1
  ENST ID: ENST00000413135
  CDS Start-End: 1-348
cgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaa

SEQ ID NO: 183183 - DNA, 3657 bp, Homo sapiens
  Payload ID: 16087
  Gene Symbol: SLC20A2
  Gene Name: solute carrier family 20 (phosphate transporter), member 2
  Uniprot ID: Q08357
  ENST ID: ENST00000342228
  CDS Start-End: 371-2329
cgcttccggaagcgggcgactcgcagctccacgcgacgccgaggggctccgcgccgggaccgggcgggtgctcggagtttcggggaccgcacgggaccgagggcaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 183184 - DNA, 533 bp, Homo sapiens
  Payload ID: 16087
  Gene Symbol: SLC20A2
  Gene Name: solute carrier family 20 (phosphate transporter), member 2
  ENST ID: ENST00000517366
  CDS Start-End: 322-533
atgatgcaaatcagcgtgttcctgcctgctgcttggctgcagttaattttagccggggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcg

SEQ ID NO: 183185 - DNA, 751 bp, Homo sapiens
  Payload ID: 16087
  Gene Symbol: SLC20A2
  Gene Name: solute carrier family 20 (phosphate transporter), member 2
  ENST ID: ENST00000522707
  CDS Start-End: 610-751
gccgaggggatgcaatctcagatcagcagccagcagtgtttgtaaacaacaggagggagattgtgctggtgatgtccaactcacaccaatgaagatcaaccggtttgtgctttgggcagcaggctgcagatggacagtgcctcctgagggcatcgccatgttttagggatccatgttgcaggatacctgtctgcaagagagagtcaaggagggctttttaagcccctggggttcaggcctggcatctgggtgttaagtagagtgaatctcctgaagtccaaactaacatatgacattttaaaatgaggaaaacaaatggctctgaaaaggtctataggattataggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcat

SEQ ID NO: 183186 - DNA, 2284 bp, Homo sapiens
  Payload ID: 16087
  Gene Symbol: SLC20A2
  Gene Name: solute carrier family 20 (phosphate transporter), member 2
  Uniprot ID: Q08357
  ENST ID: ENST00000520179
  CDS Start-End: 326-2284
cccttttcagttttttgagccggagagacgcagcggcggccccagtgccgcccccgggcgcgaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtga

SEQ ID NO: 183187 - DNA, 2992 bp, Homo sapiens
  Payload ID: 16087
  Gene Symbol: SLC20A2
  Gene Name: solute carrier family 20 (phosphate transporter), member 2
  Uniprot ID: Q08357
  ENST ID: ENST00000520262
  CDS Start-End: 695-2653
gtgcttaaaaatcaagtgaatgcctgttgggaaaaagcttactccttctctttgtcagtacttgcaaaaacaacttaaaagaagttagtattattggactgaattcagtaattagcataatcatgatgctatgtattgttcaccagggcacgccccttggccgcatttcccattaagaggacaccgatgttgtcctagtgaataaatcccggcacacatgatgcaaatcagcgtgttcctgcctgctgcttggctgcagttaattttagccggggttagttctatgagttgtaaaagtagaagttagcaagctgaaatgtgacttctcggcctaatgtggtaggatatctattttagacttcagattgtgtttgtgatcaggagagcagtcttctgaagaattgtggctcagttttcttggaaactacttgaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgc

SEQ ID NO: 183188 - DNA, 968 bp, Homo sapiens
  Payload ID: 16087
  Gene Symbol: SLC20A2
  Gene Name: solute carrier family 20 (phosphate transporter), member 2
  ENST ID: ENST00000524211
  CDS Start-End: 391-708
tttcttacattatctttgttaacccatccgcttttgtgtataatattaagttattttccactactgcaatggctagtaatttacttaggctcagagttttactctgtatggacagagaaataggaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggtagagatgacgacacaacagacagctgatgtatacgggtaatttggttagggagaagagggttagagaggaattctaccaccttctgctttcaacaggacatatcctcttgtaggaagagtcctgcagcaggaggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtt

SEQ ID NO: 183189 - DNA, 573 bp, Homo sapiens
  Payload ID: 16087
  Gene Symbol: SLC20A2
  Gene Name: solute carrier family 20 (phosphate transporter), member 2
  ENST ID: ENST00000518717
  CDS Start-End: 340-573
cttttcatattcacgtgtactcttaagaaagcgtctgttctccaaactggctttccattctccccgtcctaaatggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaac

SEQ ID NO: 183190 - DNA, 557 bp, Homo sapiens
  Payload ID: 16087
  Gene Symbol: SLC20A2
  Gene Name: solute carrier family 20 (phosphate transporter), member 2
  ENST ID: ENST00000518384
  CDS Start-End: 473-557
atttcctgccggccggtcggtttccggatgaaacgaggagccaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatg

SEQ ID NO: 183191 - DNA, 2143 bp, Homo sapiens
  Payload ID: 16088
  Gene Symbol: SLC22A6
  Gene Name: solute carrier family 22 (organic anion transporter), member 6
  Uniprot ID: Q4U2R8
  ENST ID: ENST00000360421
  CDS Start-End: 294-1946
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcacca

SEQ ID NO: 183192 - DNA, 2151 bp, Homo sapiens
  Payload ID: 16088
  Gene Symbol: SLC22A6
  Gene Name: solute carrier family 22 (organic anion transporter), member 6
  Uniprot ID: Q4U2R8
  ENST ID: ENST00000377871
  CDS Start-End: 268-1959
gaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcg

SEQ ID NO: 183193 - DNA, 1521 bp, Homo sapiens
  Payload ID: 16088
  Gene Symbol: SLC22A6
  Gene Name: solute carrier family 22 (organic anion transporter), member 6
  Uniprot ID: Q4U2R8
  ENST ID: ENST00000458333
  CDS Start-End: 1-1521
atggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctga

SEQ ID NO: 183194 - DNA, 1560 bp, Homo sapiens
  Payload ID: 16088
  Gene Symbol: SLC22A6
  Gene Name: solute carrier family 22 (organic anion transporter), member 6
  Uniprot ID: Q4U2R8
  ENST ID: ENST00000421062
  CDS Start-End: 1-1560
atggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctga

SEQ ID NO: 183195 - DNA, 1778 bp, Homo sapiens
  Payload ID: 16088
  Gene Symbol: SLC22A6
  Gene Name: solute carrier family 22 (organic anion transporter), member 6
  ENST ID: ENST00000540654
  CDS Start-End: 135-920
agctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggtggaaagagaaactggggcagcagcaacaggaacagcagatggtcccactccaagcctcctgaggactgagaaggagcagagggtggagaggaggagccct

SEQ ID NO: 183196 - DNA, 1822 bp, Homo sapiens
  Payload ID: 16089
  Gene Symbol: SLC22A7
  Gene Name: solute carrier family 22 (organic anion transporter), member 7
  Uniprot ID: Q9Y694
  ENST ID: ENST00000372574
  CDS Start-End: 1-1620
atgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagaggtgtgtgcacaggactgtgtctgtgtacgtgtgataacatgcatatggatgcaggtgctcagatacctgacaccttaggattcagacaggaaactatatctgcacatgtgtacttggtgcatgtatgtgtgcgtgcacaggtgagtgtttcagggtgcatgattgggggcatgtaaactgcaagcataaatgtgtacatgagtgtatgaacacaaatacataaggttgttcaggaa

SEQ ID NO: 183197 - DNA, 2555 bp, Homo sapiens
  Payload ID: 16089
  Gene Symbol: SLC22A7
  Gene Name: solute carrier family 22 (organic anion transporter), member 7
  Uniprot ID: Q9Y694
  ENST ID: ENST00000372585
  CDS Start-End: 96-1742
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagta

SEQ ID NO: 183198 - DNA, 2549 bp, Homo sapiens
  Payload ID: 16089
  Gene Symbol: SLC22A7
  Gene Name: solute carrier family 22 (organic anion transporter), member 7
  Uniprot ID: Q9Y694
  ENST ID: ENST00000372589
  CDS Start-End: 96-1736
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagta

SEQ ID NO: 183199 - DNA, 658 bp, Homo sapiens
  Payload ID: 16089
  Gene Symbol: SLC22A7
  Gene Name: solute carrier family 22 (organic anion transporter), member 7
  ENST ID: ENST00000436107
  CDS Start-End: 25-658
attgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcac

SEQ ID NO: 183200 - DNA, 933 bp, Homo sapiens
  Payload ID: 16089
  Gene Symbol: SLC22A7
  Gene Name: solute carrier family 22 (organic anion transporter), member 7
  ENST ID: ENST00000449231
  CDS Start-End: 99-933
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactgg

SEQ ID NO: 183201 - DNA, 846 bp, Homo sapiens
  Payload ID: 16089
  Gene Symbol: SLC22A7
  Gene Name: solute carrier family 22 (organic anion transporter), member 7
  ENST ID: ENST00000451757
  CDS Start-End: 404-846
tgggagctctgctgaccaaggggctaggggctcacctcctatgccatcacccagctacctcatcatggtagccttggtccctgaacactaatgggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactgggtgaggcagagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctg

SEQ ID NO: 183202 - DNA, 1339 bp, Homo sapiens
  Payload ID: 16089
  Gene Symbol: SLC22A7
  Gene Name: solute carrier family 22 (organic anion transporter), member 7
  ENST ID: ENST00000498232
  CDS Start-End: 99-806
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggaggtaccagaatggcagagttcgcctcagaaggctccagggtctggagaggaggagctggtgcctgctggagaggggctgatgttcataggaggtccctttctgcctgtccttgcagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgaggactgcaggcagctggggagcgggagatacaggaagtgaaagatgagattaatcagagcctgagatttgaggatagagagattgagagatgaagggaaagagaaacgaagtgaccaa

SEQ ID NO: 183203 - DNA, 1716 bp, Homo sapiens
  Payload ID: 16090
  Gene Symbol: SLC22A8
  Gene Name: solute carrier family 22 (organic anion transporter), member 8
  ENST ID: ENST00000311438
  CDS Start-End: 1-1602
atgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctga

SEQ ID NO: 183204 - DNA, 2178 bp, Homo sapiens
  Payload ID: 16090
  Gene Symbol: SLC22A8
  Gene Name: solute carrier family 22 (organic anion transporter), member 8
  Uniprot ID: Q8TCC7
  ENST ID: ENST00000336232
  CDS Start-End: 137-1765
agcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactcta

SEQ ID NO: 183205 - DNA, 1744 bp, Homo sapiens
  Payload ID: 16090
  Gene Symbol: SLC22A8
  Gene Name: solute carrier family 22 (organic anion transporter), member 8
  Uniprot ID: Q8TCC7
  ENST ID: ENST00000430500
  CDS Start-End: 116-1744
agcttgttagagctgagctgccctactacagcagctgccggcccctaggacagagcagggacctcaactacactgatcaccagccccatcggatccagacccggccaccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctga

SEQ ID NO: 183206 - DNA, 1622 bp, Homo sapiens
  Payload ID: 16090
  Gene Symbol: SLC22A8
  Gene Name: solute carrier family 22 (organic anion transporter), member 8
  Uniprot ID: Q8TCC7
  ENST ID: ENST00000545207
  CDS Start-End: 113-1468
actacagcagctgccggcccctaggacagagcagggacctcaactacactgatcaccagccccatcggatccagacccggccaccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctg

SEQ ID NO: 183207 - DNA, 1387 bp, Homo sapiens
  Payload ID: 16090
  Gene Symbol: SLC22A8
  Gene Name: solute carrier family 22 (organic anion transporter), member 8
  Uniprot ID: Q8TCC7
  ENST ID: ENST00000535878
  CDS Start-End: 119-1378
agcagctgccggcccctaggacagagcagggacctcaactacactgatcaccagccccatcggatccagacccggccaccagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacgg

SEQ ID NO: 183208 - DNA, 2343 bp, Homo sapiens
  Payload ID: 16091
  Gene Symbol: SLC22A9
  Gene Name: solute carrier family 22 (organic anion transporter), member 9
  Uniprot ID: Q8IVM8
  ENST ID: ENST00000279178
  CDS Start-End: 250-1911
tgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaatagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagttggctgctagagtctgctcggtggctcattatcaacaataaaccagaggaaggcttaaaggaacttagaaaagctgcacacaggagtggaatgaagaatgccagagacaccctaaccctggagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaagtaattcccaccataatcagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctcaaaaaaaaaaaaaaaaaaaaaagaaagaaggaaagaaagaaagaaaagaaaagaaa

SEQ ID NO: 183209 - DNA, 1558 bp, Homo sapiens
  Payload ID: 16091
  Gene Symbol: SLC22A9
  Gene Name: solute carrier family 22 (organic anion transporter), member 9
  Uniprot ID: Q8IVM8
  ENST ID: ENST00000536333
  CDS Start-End: 269-985
acatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacagtagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagttggctgctagagtctgctcggtggctcattatcaacaataaaccagaggaaggcttaaaggaacttagaaaagctgcacacaggagtggaatgaagaatgccagagacaccctaaccctggagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaaggagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaa

SEQ ID NO: 183210 - DNA, 3860 bp, Homo sapiens
  Payload ID: 16092
  Gene Symbol: SLC22A11
  Gene Name: solute carrier family 22 (organic anion/urate transporter), member 11
  Uniprot ID: Q9NSA0
  ENST ID: ENST00000301891
  CDS Start-End: 375-2027
atctgcctgactttcacttttggtgctggagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagatacaggtgtccaggttgtgcactggcccgaggcacgcagccaaggaggcgtgtggggtctgaaactcagccccggctacactggccccaccacccaccctagcaaaggctgtgtcctctccaaaaaaaggagctgttttaatcacttttcatttactcatcagtgagggagggcttccagccctatggttacgaagacggccaaacacaccaccaaacaccagacagaggaggctggcagcaggttaccacacacgtgcgcagagcccacgaagatgacgctgcactgaggcatggggcggggtgcactgaggatccgagcgagcagccagggctgcaggaaggcagctttggagcacaaagggggtggggcaactcctggcttctgcgggaaggtgtaatcagcttgtttcatcatgctgcaggctggcgagaaacggagccttacaagcgtagggataagaggaacccctcttggtcccctcgatgagggttgttgggccggggagcctcatccacagggcggagtgaaaggggagaaggggagctcacaggcaggcctgccaaggccttctggctttgccagatgtcaagggcagcacctaatactgaaccttaactttcggctttcaaccaaacggcacccttttgctgtttgttttctggaggggacaccttttcttgattcatgcccagacctcccttgtccaggccatgaaaactctgggatggtcgaggccggctgcccatctcagatgggcaaggaagcaaaagtgcagagtggtggaggggccagcttgcagaaacacggccgaacccggccctgatcctagcccagggctctttccagcacaggaggctcctagccctcgtctccaaccctccatgccactgatatctgtggccctgccacaaagttaccctcatgcccttccctggagaccccactctgggccacctcaatctcaggcccctcaactcacctctttcaccctgtgtacactgggtcaatcactcctgcctcctcacagctcccaaatccacctacttcccttcactctggctacaccctggttcacaccacggttgtagctccaaactggtccctgatgtctacattgcactctgcacaacagccaccatgcttattaagaaacgcaatccaaaccaaatccctccctgctgaaagccctccagtggctcacaataaggatcacacttctccccctgcctggtcaggcagccatgggaccccagcctttcctcccacttcggtaaattttaaaggattcggatcatacaaagaatgttcttgaaccagcatggaattaaattagaaatcaattatg

SEQ ID NO: 183211 - DNA, 1975 bp, Homo sapiens
  Payload ID: 16092
  Gene Symbol: SLC22A11
  Gene Name: solute carrier family 22 (organic anion/urate transporter), member 11
  ENST ID: ENST00000377581
  CDS Start-End: 45-1490
cagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccaga

SEQ ID NO: 183212 - DNA, 2124 bp, Homo sapiens
  Payload ID: 16092
  Gene Symbol: SLC22A11
  Gene Name: solute carrier family 22 (organic anion/urate transporter), member 11
  Uniprot ID: Q9NSA0
  ENST ID: ENST00000377585
  CDS Start-End: 311-1639
cttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaagatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccaga

SEQ ID NO: 183213 - DNA, 971 bp, Homo sapiens
  Payload ID: 16092
  Gene Symbol: SLC22A11
  Gene Name: solute carrier family 22 (organic anion/urate transporter), member 11
  ENST ID: ENST00000428570
  CDS Start-End: 1-220
tttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaaggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccaga

SEQ ID NO: 183214 - DNA, 947 bp, Homo sapiens
  Payload ID: 16092
  Gene Symbol: SLC22A11
  Gene Name: solute carrier family 22 (organic anion/urate transporter), member 11
  ENST ID: ENST00000416590
  CDS Start-End: 1-462
ttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcgcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccaga

SEQ ID NO: 183215 - DNA, 1854 bp, Homo sapiens
  Payload ID: 16093
  Gene Symbol: SLC22A12
  Gene Name: solute carrier family 22 (organic anion/urate transporter), member 12
  Uniprot ID: Q96S37
  ENST ID: ENST00000336464
  CDS Start-End: 295-1854
aaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacaggtttgggcgcaggctggtgctaacctggagctaccttcagatggctgtgatggtgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttag

SEQ ID NO: 183216 - DNA, 2599 bp, Homo sapiens
  Payload ID: 16093
  Gene Symbol: SLC22A12
  Gene Name: solute carrier family 22 (organic anion/urate transporter), member 12
  Uniprot ID: Q96S37
  ENST ID: ENST00000377567
  CDS Start-End: 465-1802
atagctgaggtggggctctgcaggaggcatagatttggggaggggacagagatctcagggtggcattgggcacaccgaacctggggagtctgtggggtgtctgttgatgctgggaagctccaccgaggactcaggacagggtaacagcaaagcgggcacaggacgccaaccacagcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacaggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggc

SEQ ID NO: 183217 - DNA, 2887 bp, Homo sapiens
  Payload ID: 16093
  Gene Symbol: SLC22A12
  Gene Name: solute carrier family 22 (organic anion/urate transporter), member 12
  Uniprot ID: Q96S37
  ENST ID: ENST00000377572
  CDS Start-End: 748-2085
ccacagcaggtgagtggaggcaggagccacgggtggggccaggccacacagcctgggaggcgcaggggctgggcagctgccagtgacccaagcccacacagagacttgcacagctgccccagccccaaattagggggatcccctggcccaccttctcttggctcagccactctgggaggtgggcacacaggggcaccgaagggagcaggcagccctggcatcccacagccgccaggagaaaaacttaggcctccccaagacctggcacagagcaggccggccctggcccccaagcagaggaggctgcacctccctcgcgtctgtgcctgcctcaacgcgggttaaactttgaccaaggaaatgattgctaaactcgattccataagtgtcaccggtcacactttaattccagtctaaaattaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacaggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggctgccc

SEQ ID NO: 183218 - DNA, 3206 bp, Homo sapiens
  Payload ID: 16093
  Gene Symbol: SLC22A12
  Gene Name: solute carrier family 22 (organic anion/urate transporter), member 12
  Uniprot ID: Q96S37
  ENST ID: ENST00000377574
  CDS Start-End: 748-2409
ccacagcaggtgagtggaggcaggagccacgggtggggccaggccacacagcctgggaggcgcaggggctgggcagctgccagtgacccaagcccacacagagacttgcacagctgccccagccccaaattagggggatcccctggcccaccttctcttggctcagccactctgggaggtgggcacacaggggcaccgaagggagcaggcagccctggcatcccacagccgccaggagaaaaacttaggcctccccaagacctggcacagagcaggccggccctggcccccaagcagaggaggctgcacctccctcgcgtctgtgcctgcctcaacgcgggttaaactttgaccaaggaaatgattgctaaactcgattccataagtgtcaccggtcacactttaattccagtctaaaattaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacaggtttgggcgcaggctggtgctaacctggagctaccttcagatggctgtgatgggtacggcagctgccttcgcccctgccttccccgtgtactgcctgttccgcttcctgttggcctttgccgtggcaggcgtcatgatgaacacgggcactctcctgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggc

SEQ ID NO: 183219 - DNA, 2522 bp, Homo sapiens
  Payload ID: 16093
  Gene Symbol: SLC22A12
  Gene Name: solute carrier family 22 (organic anion/urate transporter), member 12
  Uniprot ID: Q96S37
  ENST ID: ENST00000473690
  CDS Start-End: 727-1725
attaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgaagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacagtgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcagggctctgcattctggccaacacgctggtgccccacgaaatgggggctctgcgctcagccttggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggc

SEQ ID NO: 183220 - DNA, 2555 bp, Homo sapiens
  Payload ID: 16094
  Gene Symbol: SLC22A13
  Gene Name: solute carrier family 22 (organic anion/urate transporter), member 13
  Uniprot ID: Q9Y226
  ENST ID: ENST00000311856
  CDS Start-End: 50-1705
acagagctaccctagtgtccccaggctgaggaggtagtgactggcatacatggctcagtttgtccaggtcctggctgaaataggtgactttggtcgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgagttcaacctggtttgtgatcggaagcacctgaaggacaccacacagtcagtgttcatggctgggctccttgttggcaccctcatgtttgggcccctctgcgaccggattggccgcaaggccacaatcctggcgcagctgctcctcttcaccctcatcggcctggccacagcttttgtgcccagctttgagctctacatggccctgcgctttgctgtggctactgccgtcgctggacttagcttcagcaatgtcaccctactgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctgggctctgccagaatctgcacgttggctcctgacccgtgggaggatggacgaggcgatacaactgatccagaaggcggcctcggtcaataggcggaaactctccccggagctcatgaaccagctggtcccagagaagacaggcccctcagggaatgccctggatctgttcagacacccccagctccggaaggtgaccctgattatcttctgtgtctggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcagatctgcccgtggtggtcaccatgctggctgtggtggggaagatggccacagctgctgcctttaccatctcctatgtgtactctgccgagcttttccccaccatcctccggcagacaggcatggggctggtgggcatcttctcacggatcgggggcatcctcacaccacttgtgatcctgctgggagagtaccacgctgccctccccatgctcatctacggcagcctccccatcgtggccggcctgctgtgcaccctgctgccagagacgcatggccagggcctgaaagacaccctccaggacctggagctggggcctcacccacggtcccccaaatcagtgccctcagagaaggaaacagaggccaagggaagaacttccagcccgggagtggcctttgtgagcagcacatacttctgattgaggtctctaagagctggaccatcagcagcagggagctgcctaaacacctccttggatatggccaggacccacagggacacagggcaagaccagccttgcttatggaggcaggacaccacaatctggcccatggctgtcacctcctgccgagtccaatcccagactgggaaccaccatctgagacaggacctcccggcctccttcacctttctcatctccagagccctgcccccaatactctgtctgggttaggatcttgggtatgtcttggaattaacttgtcctctaacaatcttcatggggtatggctctcttgatctcctcaatctggagtcccctgccctcaaaacacagtgatgttcagaacagaacacaaggtaagccctttccaatttgtgggaacaggaggggagaggaaacaaatgtgaagttgtggactctacccaggcaggtggatgaaaatgctgtggataaaaggaaggttatgattccttctagcggatggaccagattcctctggctaacgtatggccccataggtcactgggtcatacagagagaagattcagttcagcctaaatcaaaacttccaccttgtgttcacttcaaagatggcccaacccccgccctacactcagctcatgcctaacctatgtgtggctcagggaccagcttggggaaggaaaggaggtttgttctgctccccgcctcaccccgcctcctcctgctcatgctcagctgcttctggaccttccagggcccatgcagggtgagggaaagggtagaggtcttttcaccgagctgctgctggttgcagttctttctggtgcacattggctaatgccag

SEQ ID NO: 183221 - DNA, 1079 bp, Homo sapiens
  Payload ID: 16094
  Gene Symbol: SLC22A13
  Gene Name: solute carrier family 22 (organic anion/urate transporter), member 13
  ENST ID: ENST00000415844
  CDS Start-End: 1-696
cgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgagttcaacctggtttgtgatcggaagcacctgaaggacaccacacagtcagtgttcatggctgggctccttgttggcaccctcatgtttgggcccctctgcgaccgtgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctgggctctgccagaatctgcacgttggctcctgacccgtgggaggatggacgaggcgatacaactgatccagaaggcggcctcggtcaataggcggaaactctccccggagctcatgaaccagctggtcccagagaagacaggcccctcagggaatgccctggatctgttcagacacccccagctccggaaggtgaccctgattatcttctgtgtctggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcagatctgcccgtggtggtcaccatgctggctgtggtggggaaga

SEQ ID NO: 183222 - DNA, 1521 bp, Homo sapiens
  Payload ID: 16095
  Gene Symbol: SLC22A1
  Gene Name: solute carrier family 22 (organic cation transporter), member 1
  Uniprot ID: O15245
  ENST ID: ENST00000324965
  CDS Start-End: 1-1521
atgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcagcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaa

SEQ ID NO: 183223 - DNA, 1948 bp, Homo sapiens
  Payload ID: 16095
  Gene Symbol: SLC22A1
  Gene Name: solute carrier family 22 (organic cation transporter), member 1
  Uniprot ID: O15245
  ENST ID: ENST00000366963
  CDS Start-End: 148-1812
ctacttggttgccttccagatgtttcacacttggacagcaaactgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaagaa

SEQ ID NO: 183224 - DNA, 1452 bp, Homo sapiens
  Payload ID: 16095
  Gene Symbol: SLC22A1
  Gene Name: solute carrier family 22 (organic cation transporter), member 1
  Uniprot ID: O15245
  ENST ID: ENST00000457470
  CDS Start-End: 1-1452
atgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcagaaaagcaaagcccaaagaaaacacgatttaccttaaggtccaaacctcagaaccctcgggcacctga

SEQ ID NO: 183225 - DNA, 1484 bp, Homo sapiens
  Payload ID: 16095
  Gene Symbol: SLC22A1
  Gene Name: solute carrier family 22 (organic cation transporter), member 1
  Uniprot ID: O15245
  ENST ID: ENST00000460902
  CDS Start-End: 1-1062
atgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaag

SEQ ID NO: 183226 - DNA, 653 bp, Homo sapiens
  Payload ID: 16095
  Gene Symbol: SLC22A1
  Gene Name: solute carrier family 22 (organic cation transporter), member 1
  ENST ID: ENST00000540443
  CDS Start-End: 509-653
ctgtcctggagggcagaggcagaaaaggtggaagaggtagaagaagagacaggcacactcggtgtaaattttattgaaaaaaaaaaatctgtaagtggacccgcgcagttcaaacccatgttgttcgagggttagttgcatttgatatttgctgagtgattcatcagaaactttgaatttgtcttatgaaaatgtagtaggagaaaactctgtgaaacagcccagggataccgagtttgatgaactgcatttgctttgctgaagagaggatggaagggtgtagtcctgactcacacatggttctgtgcttttcgtcctcctcttgccgtggtatgactggcagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtacc

SEQ ID NO: 183227 - DNA, 1598 bp, Homo sapiens
  Payload ID: 16095
  Gene Symbol: SLC22A1
  Gene Name: solute carrier family 22 (organic cation transporter), member 1
  ENST ID: ENST00000539263
  CDS Start-End: 38-460
gcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctga

SEQ ID NO: 183228 - DNA, 664 bp, Homo sapiens
  Payload ID: 16096
  Gene Symbol: SLC22A18AS
  Gene Name: solute carrier family 22 (organic cation transporter), member 18 antisense
  Uniprot ID: Q8N1D0
  ENST ID: ENST00000526203
  CDS Start-End: 127-579
catggcttcctgggcctaccctcgttctgctactcatggaccagtgtgtttgcctctggaagcctctgtctcctcggctgtaaagcgggcctacgacattgaccgaccacccatgaggttgtggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctaga

SEQ ID NO: 183229 - DNA, 1659 bp, Homo sapiens
  Payload ID: 16096
  Gene Symbol: SLC22A18AS
  Gene Name: solute carrier family 22 (organic cation transporter), member 18 antisense
  Uniprot ID: Q8N1D0
  ENST ID: ENST00000625099
  CDS Start-End: 498-1259
agggaagtggggtggctccccatggcttctcccggggctggcactgaagctggagcacaggatgtgctgacgggggtccagaggcagagtccttaacttactcagcttaagcgtggcatgagtcccaactgggaggggccctggcagcatgaaacccccacccccactctctgcgacggcccagatggagggcaggaggaacagcggttcagccctggctggggctgcaggggctggggtgtgttactcactggcacgatggagaactgcatgaagaggcagcggagtgctgtctgtccccacccttccccgcccggcctccaactggtgggaactggattttgcggctgcagaggacttccccaaattttgccacattaacagctgactgcacatctgagccccgaggtgaagcagggcctcaggtagccagggaactggttgagcagaggaaatcggagagacctttttttttgtcatgaacaggctcagtgtgaatgggggaacttcctggttctgagggaatgtgggaaaattgccctttaggctgggtgaagaagaaagcaagtggaaccctggcacccctggacttcctcctccagaggaagcggctttggttgtgggccagcgagcctgtgcgtccccagccccagggcattcaccgcttcagagaagcaaggcgacagttctgccggatgagaggatccaggctgactggaggaaggaagggctttggctcatctgggctcaggtttgggagaggtggcttctcagaggaggtgatgcctcagccagtcttaaaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctagacagatgtttgcttgcttctgggcccattgggcctcctctcagagcctggaactcccagcccccagctcctggggtgccttcctccaggtgtgtccctggcttgggctggggggacacagccccgctcctgggacgtgcaggtttaaaatgctattgggtaccatctttgatcgaattcagagtgacagacttagagcaggtcacctctcagcttctaacgaggccaagacggaggaatccccacagcactgggtttgactctgtaattaagctggtaaagtggaaaaataaaagtaggaaacctaagtggaaacc

SEQ ID NO: 183230 - DNA, 697 bp, Homo sapiens
  Payload ID: 16096
  Gene Symbol: SLC22A18AS
  Gene Name: solute carrier family 22 (organic cation transporter), member 18 antisense
  Uniprot ID: Q8N1D0
  ENST ID: ENST00000455942
  CDS Start-End: 162-614
ctggcacgatggagaactgcatgaagaggcagcggagtgctgtctgtccccacccttccccgcccggcctccaactggtgggaactggattttgcggctgcagaggacttccccaaattttgccacattaacagctgactgcacatctgagccccgaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcaccta

SEQ ID NO: 183231 - DNA, 3737 bp, Homo sapiens
  Payload ID: 16097
  Gene Symbol: SLC22A2
  Gene Name: solute carrier family 22 (organic cation transporter), member 2
  ENST ID: ENST00000366952
  CDS Start-End: 1483-2487
gctgaacagtgctctcgctgaggtcagggggagaagatggcaggggtgaatccttgacgatcacggagtaaggacgagaatgcagtttgcttcccacaggcccctccctcaacatgccaagattcctacctggggcatcaagactgcaggtggggccaagaaaagacatggacactcaaagtcaagctctttgacggggaacaggtgcagacagagcagccttggcttccggctcatgcactcacgatgctggctgcgaatgggaagtccctaaacagaactgagccccctcattcagctcagagcaaacggggctggcagcagcccagggcaccacgaagcagagtgcctctgtgtgcccaacacagccgcagtggaggtcaatggatgtccttgccggcgccctgctttttgcttttttaagaaaataagaagcctgcagctgcggcaaggagaaagaccccgtgggtcgctccttttagactacgctattacacctgctgactatccaatagaaaaaagaaggagaaggaaaatcgggttaactttctggtatttagtttgcagatatgtcagcaggccaccttctctacttggcaggatcacgatgtattaagaatccttttgtccaccaggaaagacaaatttcctgtttgtcttgcatttagatgcaacaacatcatcctaaagagatgcccctgatgtgtgagagcagaaaggggtgatccctttcttccttatcctaaggctcacggccaacacccctataacaaaagacaggttaacaagagaaaagcatgacaaatttatttgatcacgttttacatgacacaggagccttcattcagaatgaagacccacagatacagggaaaactggatggcagtatagaactgtagttggacaaaaagggcagcagcccatgttcgcaggctgaggggaaaacccagcaaggcctgtctgttcagatccgtcttggcccctctgtgcagcactccttcctccaggcaccggggacaagactcctctggaatgcgggtctggatttctttacggcccactgttacacagaaaggcagcggggaagttacagtggtatttctaggctttctggctggctttggggagaaaagagtctggtttccacgagctgctttgaggaagaaggattctcagttctatggcttgccccgggggagaatgatgggtgagagaagagacaggagggcaggagaaggtcagagagagagactttgcttctgaggcctccaccttggggcatggatttctgagccccaacagaccttgacagaaaaatctaggacacaaagatagtggcttggacacacctgcctgcatttacacttgacctgtctgcgacgtaaacactttcctctttccctccagatgggttaaggggaaggacacttcagggttgaaacgcaggaataccagattggatttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagtttctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggtaaggaatatttttcactttgaaatgcctccaaattgttttaatcacagtcatccatagtaaggaagggaagaaaacatgacctcatcccggtattagcgctgacggtgggcagcaatgtgggttgtgtctggtaggttttcctgatcgtgtttttcttgggcaaatattaagatcggtgtagcccctaagcacagatcaaggcaatggcaacctcggcttcacattggaatcacctgggagcttacaaaataccaaagccaaaacccccagaaatactgatttaattgttctagggtagggcttggaaaccaatagttttttaattctccaggtgattcaaatgcatagcccaactagagaactattggtataacttaattgatgatgcatgtagatctctattgtagtacagaactggcaaaaaacaaacaaacaaaaaacagggttgtggggggattgccttttctttcctttttttcttttctacctggagaaaaaataaatttctgaacaagaataattccagtggcttcacagcccagtgacttgatctttattgtgtttgctacctacaggctgctctcagagcttcaagccatgctttctctagtggggaatgcatcttttcagggcacattggatctccacccaggcaaatggagatttacaatcactgacaaaagcaaagctcatgaggaattactttagcaacctttacaatagtgcacaggagaggcagctttgaaatttggcctcattatccttctttccttttctgagtaatcgtgacttttgttgattatcctcatattttccattacatgtaatgactatgtttagttaataaactagaaacattgtccaaatgttgttcgtaacaggccaggagagaagtcaccaagaagggaggccgtactcacttggtcttctggtttcctaaaatttgaattaagtagtcagttctttcgatcccaattgcactagaataccccaaagagagaaataactcacaaccactaataacttgatatagttttactaaataaatcattccattggccaggcacagtggctcacacctggaatcccagcatttcgggaggctgaggcaggcagatcacatgaagccaggagttcaagaccagcctggttaacatggcaaaaccccatgtctactaaaagcacaaaaattagcaggtggtacacgtctgtaatcccaactactagggaggctgaggcaggggaataact

SEQ ID NO: 183232 - DNA, 2597 bp, Homo sapiens
  Payload ID: 16097
  Gene Symbol: SLC22A2
  Gene Name: solute carrier family 22 (organic cation transporter), member 2
  Uniprot ID: O15244
  ENST ID: ENST00000366953
  CDS Start-End: 260-1927
gttataataaacacgacaggcatcctgggagtgagctcagggcatttgggaagtgcagaaggacatgcacccccgctggaggggtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagtttctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtgcttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgaagaaatttttaaaaatacattgattattatctaggttagacttaaagtgaatctcaaataaaagaatcaggaatacaacttaagtgatcatgaggtccttccatatttagattgggtaagcatgaatgtgtattttctacaaaagaccttgagaagagttcaataaaaaatgttagcattat

SEQ ID NO: 183233 - DNA, 3348 bp, Homo sapiens
  Payload ID: 16098
  Gene Symbol: SLC22A3
  Gene Name: solute carrier family 22 (organic cation transporter), member 3
  Uniprot ID: O75751
  ENST ID: ENST00000275300
  CDS Start-End: 153-1823
gcggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgctcggctccccttgtgccgtgccgcggcggctggcgctacgcccaggcccactccaccatcgtcagcgagtttgaccttgtctgtgtcaatgcgtggatgctggacctcacccaagccatcctgaacctcggcttcctgactggagcattcaccttaggctatgcagcagacaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattgtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactgggtggtccctgagtctccccgttggctgattactcggaagaaaggagataaagcattacagatcctgagacgcattgctaagtgcaatgggaaatacctctcatcaaattactcagagatcactgttacagatgaggaagttagtaatccatcctttttagatctggtgagaactccccaaatgaggaaatgcacacttattcttatgtttgcttggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaaggaatagcatggttgaggaccacagtggctacattgggaagactagggataaccatggcctttgaaattgtttatttggtaaattcagaattgtacccaacaacattacgaaatttcggagtttcgctctgttcaggtctgtgtgattttgggggaatcatagccccatttctgctctttcggctagcagccgtgtggctagaactacctctgatcatctttggtatcctggcatccatctgtggtggccttgtgatgcttttgcctgaaaccaagggtattgccttgccagagacagtggatgatgtagaaaaacttggcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgta

SEQ ID NO: 183234 - DNA, 2033 bp, Homo sapiens
  Payload ID: 16099
  Gene Symbol: SLC22A16
  Gene Name: solute carrier family 22 (organic cation/carnitine transporter), member 16
  Uniprot ID: Q86VW1
  ENST ID: ENST00000330550
  CDS Start-End: 285-1916
tcgaggggccagatctcactcgtagggggtgcctgtgcctggccgcccgtttctctaatccgccgccacttccctagacggctgctgcccagttctgccctgcgcctccgtagggcctccctctgtgcctggcaggtgttccccagggacaaccgttagtcagagttggttgccgtttattaaaacctaatacgtgccaggtacactgtacctggcgcttacacatagttcttcatttgatgttcaccgggaccctgcaaaggaggagtagtgaaaatgtgtatatgaggactctgcatgcagtttctcatccttacagtaactcaatgagattccagagagtcctctatttcatatgtgccttccagaacatctcttgtggtattcactacttggcttctgtgttcatgggagtcacccctcatcatgtctgcaggcccccaggcaatttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgt

SEQ ID NO: 183235 - DNA, 1987 bp, Homo sapiens
  Payload ID: 16099
  Gene Symbol: SLC22A16
  Gene Name: solute carrier family 22 (organic cation/carnitine transporter), member 16
  Uniprot ID: Q86VW1
  ENST ID: ENST00000368919
  CDS Start-End: 68-1801
ggggcggggcgcgctacccgcagtccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagttttaaaaa

SEQ ID NO: 183236 - DNA, 1968 bp, Homo sapiens
  Payload ID: 16099
  Gene Symbol: SLC22A16
  Gene Name: solute carrier family 22 (organic cation/carnitine transporter), member 16
  ENST ID: ENST00000451557
  CDS Start-End: 1-1299
gattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagctcctaggacagcaccttcaggagtaataatgcaggcagtagctggcaattaaggaggcactccatggtgggtcatgaaggaatgaatgagtgagtgatgagattaaacctcgttgatgaggaaaagaactcgaagtccagcacaagtaaccaaagatctcaccgagtaatcacagtgacaactgttatgtcaaattcaaatccattaccctctgaaaacagttaggaaattctattctccgaagggttcgttcctttcttgatgtgtcacttatcattatttttaattccttctagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagttttaaaaa

SEQ ID NO: 183237 - DNA, 737 bp, Homo sapiens
  Payload ID: 16099
  Gene Symbol: SLC22A16
  Gene Name: solute carrier family 22 (organic cation/carnitine transporter), member 16
  ENST ID: ENST00000424139
  CDS Start-End: 216-737
gcgcagtcgggacacgggcgtccagacgccggcccctagctgggcttctcctctaggcctctggcagcgggacctggcatggtgagcagaggcgctgggctcgctcggagtgcgcctgttgccgggcaggagggacctgattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatg

SEQ ID NO: 183238 - DNA, 1021 bp, Homo sapiens
  Payload ID: 16099
  Gene Symbol: SLC22A16
  Gene Name: solute carrier family 22 (organic cation/carnitine transporter), member 16
  ENST ID: ENST00000434949
  CDS Start-End: 221-1021
gcggcgctcgcgatccgaaaacatctccacttcctcctcaccccgcgcagtcgggacacgggcgtccagacgccggcccctagctgggcttctcctctaggcctctggcagcgggacctggcatgattccagagagtcctctatttcatatgtgccttccagaacatctcttgtggtattcactacttggcttctgtgttcatgggagtcacccctcatcatgtctgcaggcccccaggcaatgctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccag

SEQ ID NO: 183239 - DNA, 1213 bp, Homo sapiens
  Payload ID: 16099
  Gene Symbol: SLC22A16
  Gene Name: solute carrier family 22 (organic cation/carnitine transporter), member 16
  ENST ID: ENST00000437378
  CDS Start-End: 160-1213
ccgcgcagtcgggacacgggcgtccagacgccggcccctagctgggcttctcctctaggcctctggcagcgggacctggcatgattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgg

SEQ ID NO: 183240 - DNA, 3237 bp, Homo sapiens
  Payload ID: 16100
  Gene Symbol: SLC22A5
  Gene Name: solute carrier family 22 (organic cation/carnitine transporter), member 5
  Uniprot ID: O76082
  ENST ID: ENST00000245407
  CDS Start-End: 222-1895
gcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttattgtttatttgtttgttgttgtatccttttctccttgttatttgcccttcagaatgcacttgggaaaggctggttccttagcctcctggtttgtgtctttttttttttttttttaaaacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaataaca

SEQ ID NO: 183241 - DNA, 720 bp, Homo sapiens
  Payload ID: 16100
  Gene Symbol: SLC22A5
  Gene Name: solute carrier family 22 (organic cation/carnitine transporter), member 5
  ENST ID: ENST00000415928
  CDS Start-End: 1-720
gacgtggacctggggcagctggagcaggagagctgtctggatggctgggagttcagtcaggacgtctacctgtccaccattgtgaccgagcaagacagtggggcctacaatgctatgaaaaacaggatgggaaagaagcctgctctctgccttcctgcccagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgag

SEQ ID NO: 183242 - DNA, 998 bp, Homo sapiens
  Payload ID: 16100
  Gene Symbol: SLC22A5
  Gene Name: solute carrier family 22 (organic cation/carnitine transporter), member 5
  ENST ID: ENST00000447841
  CDS Start-End: 1-112
gttcctgcagttacaagacctaagttccaagaagcagcagtcccacaacattctggatctgcttcgaacctggaatatccggatggtcaccatcatgtccataatgctgtgacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttaca

SEQ ID NO: 183243 - DNA, 850 bp, Homo sapiens
  Payload ID: 16100
  Gene Symbol: SLC22A5
  Gene Name: solute carrier family 22 (organic cation/carnitine transporter), member 5
  ENST ID: ENST00000437841
  CDS Start-End: 74-499
gccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatca

SEQ ID NO: 183244 - DNA, 852 bp, Homo sapiens
  Payload ID: 16100
  Gene Symbol: SLC22A5
  Gene Name: solute carrier family 22 (organic cation/carnitine transporter), member 5
  ENST ID: ENST00000448810
  CDS Start-End: 1-410
ggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtgcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaagggtaa

SEQ ID NO: 183245 - DNA, 1746 bp, Homo sapiens
  Payload ID: 16100
  Gene Symbol: SLC22A5
  Gene Name: solute carrier family 22 (organic cation/carnitine transporter), member 5
  Uniprot ID: O76082
  ENST ID: ENST00000435065
  CDS Start-End: 1-1746
atgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgagcaagacagtggggcctacaatgctatgaaaaacaggatgggaaagaagcctgctctctgccttcctgcccagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaa

SEQ ID NO: 183246 - DNA, 2201 bp, Homo sapiens
  Payload ID: 16101
  Gene Symbol: SLC22A4
  Gene Name: solute carrier family 22 (organic cation/zwitterion transporter), member 4
  Uniprot ID: Q9H015
  ENST ID: ENST00000200652
  CDS Start-End: 175-1830
cgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaaccctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaa

SEQ ID NO: 183247 - DNA, 2026 bp, Homo sapiens
  Payload ID: 16102
  Gene Symbol: SLC22A10
  Gene Name: solute carrier family 22, member 10
  Uniprot ID: Q63ZE4
  ENST ID: ENST00000332793
  CDS Start-End: 3-1628
caatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcaggtactttatggagctgtcgctctcatagttcgatgtcttgctcttttgacactaaatcatatgggccgtcgaataagccagatattgttcatgttcctggtgggcctttccattttggccaacacgtttgtgcccaaagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcaaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatg

SEQ ID NO: 183248 - DNA, 2234 bp, Homo sapiens
  Payload ID: 16102
  Gene Symbol: SLC22A10
  Gene Name: solute carrier family 22, member 10
  ENST ID: ENST00000533483
  CDS Start-End: 167-1285
tttattgtcaacagctagaagtatctctatgaaataatgatctctatgactacaaaataacatctacctcctgatagcaaaagaactgaggaagctctttccactacggctgtattgcactgagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcaaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaa

SEQ ID NO: 183249 - DNA, 864 bp, Homo sapiens
  Payload ID: 16102
  Gene Symbol: SLC22A10
  Gene Name: solute carrier family 22, member 10
  ENST ID: ENST00000532724
  CDS Start-End: 24-818
ctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgat

SEQ ID NO: 183250 - DNA, 699 bp, Homo sapiens
  Payload ID: 16102
  Gene Symbol: SLC22A10
  Gene Name: solute carrier family 22, member 10
  ENST ID: ENST00000526800
  CDS Start-End: 15-632
gttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagaaaaaaaaatctcaaggaaaaggcataaaaatgattgctacacaaaagtgaccaaattttaagaagccttcatgagctgattggtggggaaattc

SEQ ID NO: 183251 - DNA, 2202 bp, Homo sapiens
  Payload ID: 16103
  Gene Symbol: SLC22A14
  Gene Name: solute carrier family 22, member 14
  Uniprot ID: Q9Y267
  ENST ID: ENST00000273173
  CDS Start-End: 92-1876
ggccagttcctagtcggtggctcccatgctggtctctgatgtttaggaagtggtgtcagcagagactgagctgcaccctttctttggacagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctatcatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttggccactgagtggttagtgggtgagcaccgggcccatgccattatcctgggacactgctttttcgctgttggggccgtgttgctgacagggatcgcctacagtcttccccactggcagctgctgtttctggtgggtgggatacttgtgatccccttcatctcctatatctggattctcccggagtccccgcggtggctgatgatgaaagggaaggtgaaggaggccaagcaggtgctgtgctacgccgcaagtgtgaacaagaagaccattccttcaaatctgctggacgagctgcagctgcccagaaagaaggtgactcgggcctctgtcctggacttctgtaagaataggcagctctgcaaggtgaccttggtgatgagctgtgtgtggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggaataaggtcaaggacatgaagactaaggaaacatcatctgatgatgtctgaggaagcggccaagaatgtcattctcaatgcccagatcctgagattggacccataccctgtctccaaccctgccttgaagcaattcaataaagaggaagcaaacagccaggctccctgagggccaggcccccagaccatcttgggttggaattgagtggccaagtatggggtcatggattccaggccacaaattccaggcctagttcagtctgggggcagggtcagtccttctcccaggccagcccttgacattaaaaaaaatgccccctccttctgcaggagctctgctgtgattcattccaataaaggtacaatgttggtcttga

SEQ ID NO: 183252 - DNA, 1827 bp, Homo sapiens
  Payload ID: 16103
  Gene Symbol: SLC22A14
  Gene Name: solute carrier family 22, member 14
  Uniprot ID: Q9Y267
  ENST ID: ENST00000448498
  CDS Start-End: 43-1827
gttctgcttccaagggtctggctgggcctggattgtggtcagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctatcatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttggccactgagtggttagtgggtgagcaccgggcccatgccattatcctgggacactgctttttcgctgttggggccgtgttgctgacagggatcgcctacagtcttccccactggcagctgctgtttctggtgggtgggatacttgtgatccccttcatctcctatatctggattctcccggagtccccgcggtggctgatgatgaaagggaaggtgaaggaggccaagcaggtgctgtgctacgccgcaagtgtgaacaagaagaccattccttcaaatctgctggacgagctgcagctgcccagaaagaaggtgactcgggcctctgtcctggacttctgtaagaataggcagctctgcaaggtgaccttggtgatgagctgtgtgtggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggaataaggtcaaggacatgaagactaaggaaacatcatctgatgatgtctga

SEQ ID NO: 183253 - DNA, 523 bp, Homo sapiens
  Payload ID: 16103
  Gene Symbol: SLC22A14
  Gene Name: solute carrier family 22, member 14
  ENST ID: ENST00000466887
  CDS Start-End: 166-523
aaaggttctgcttccaagggtctggctgggcctggattgtggtcagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctatcatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacg

SEQ ID NO: 183254 - DNA, 1230 bp, Homo sapiens
  Payload ID: 16104
  Gene Symbol: SLC22A15
  Gene Name: solute carrier family 22, member 15
  Uniprot ID: Q8IZD6
  ENST ID: ENST00000369502
  CDS Start-End: 15-752
gcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctgttctttgcagttggcattgcccaatatgccctgttaggatacttcatccgctcctggaggaccctagccattctggttaacctgcagggaacggtggtctttctcttatctttggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtaattatactaaggcgtgttctgttgctctttaactaaggttgctcgagcttctcttgatatcctgctccttcttcagggtacagggaattttacctcttttgttagcttgaggttgttttctcaacagcaagtctcctgatccttagcgcctggttttctgcttgcgcagccccgtctttctcaagtagcagatgatagtgcctgatgggcaggtccactgagcttgagtaagtagacatcagaagcacatctttgcttttgaggtatttatcataaatatttaagccttcctgccccttcccctgc

SEQ ID NO: 183255 - DNA, 4720 bp, Homo sapiens
  Payload ID: 16104
  Gene Symbol: SLC22A15
  Gene Name: solute carrier family 22, member 15
  Uniprot ID: Q8IZD6
  ENST ID: ENST00000369503
  CDS Start-End: 131-1774
gccgccagcgcttccatccccgccccggcgggtccaagccggtgccgggcgcccaggggttgccgcgctgggcgggagggcagcgcctgagagggcggtggggtggcggggttcctgcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctgttctttgcagttggcattgcccaatatgccctgttaggatacttcatccgctcctggaggaccctagccattctggttaacctgcagggaacggtggtctttctcttatctttattcattcctgaatcacctcgttggttatactcccagggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtttgtgtgcagcttggtgtattatggcctaactctgagtgcgggtgatctaggtggaagtatttatgccaacctggccctgtctggcctcatagagattccatcttaccctctctgtatctacttgattaaccaaaaatggtttggtcggaagcgaacattatcagcatttctgtgcctaggaggactggcttgtcttattgtaatgtttcttccagaaaagaaagacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtgtccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatataccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattataagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcctctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttcattgacaggtaatgtattttggttgtgcggatggtttgtaaaaagtatcctgtttttttaattctattcaaaattaaaaattttttttcctaaaataaagcaagaaaaataaatgtaagatatataagaaaccccagagtttccagggtgaaagttcacattagcagcttgtccaaaatatttacacctcacaaatattttgaaagaaaccatgttgaaattttctgattttgtgagttacaaccacagcccagtaaaaccaatacttgttatttggctactttcaagcaatgcagatattctttagtatttaaaaatgagcaaataaacaaaatgaggcaaataaatgaagaaaatgagtttctgagacactgtttaggtaaccataaatcagacagatatttttatggtgggcaaattgatgaagatacttttagtaggtgatttatattcataacaaatacatattgaaataattgtcactactgtatcagaattaaaaaccagcttcacattaggacttctccatacaaatgctttatcattggttcttaaattggaaaaatatctataaatgattacatttttaagctaaataaaatgcagatattttggcttcttgtgaatgtaataaagaatcataaaacata

SEQ ID NO: 183256 - DNA, 2284 bp, Homo sapiens
  Payload ID: 16105
  Gene Symbol: SLC22A17
  Gene Name: solute carrier family 22, member 17
  Uniprot ID: Q8WUG5
  ENST ID: ENST00000206544
  CDS Start-End: 338-1954
cctgactgccttcctagccctccctcccacctgccccctgcccttgctctgcggtttcctccgcttcacccttctcctgccaccccctgccccccaacagcaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagagatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagca

SEQ ID NO: 183257 - DNA, 2409 bp, Homo sapiens
  Payload ID: 16105
  Gene Symbol: SLC22A17
  Gene Name: solute carrier family 22, member 17
  Uniprot ID: Q8WUG5
  ENST ID: ENST00000354772
  CDS Start-End: 505-2067
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcatatcatagcctg

SEQ ID NO: 183258 - DNA, 2245 bp, Homo sapiens
  Payload ID: 16105
  Gene Symbol: SLC22A17
  Gene Name: solute carrier family 22, member 17
  ENST ID: ENST00000397260
  CDS Start-End: 682-1911
gcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcatatc

SEQ ID NO: 183259 - DNA, 2455 bp, Homo sapiens
  Payload ID: 16105
  Gene Symbol: SLC22A17
  Gene Name: solute carrier family 22, member 17
  Uniprot ID: Q8WUG5
  ENST ID: ENST00000397267
  CDS Start-End: 505-2121
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagagatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcatatc

SEQ ID NO: 183260 - DNA, 1542 bp, Homo sapiens
  Payload ID: 16106
  Gene Symbol: SLC22A18
  Gene Name: solute carrier family 22, member 18
  Uniprot ID: Q96BI1
  ENST ID: ENST00000347936
  CDS Start-End: 219-1493
gacaaaaaaaaaggtctctccgatttcctctgctcaaccagttccctggctacctgaggccctgcttcacctggaggaagacagtggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 183261 - DNA, 1628 bp, Homo sapiens
  Payload ID: 16106
  Gene Symbol: SLC22A18
  Gene Name: solute carrier family 22, member 18
  Uniprot ID: Q96BI1
  ENST ID: ENST00000312221
  CDS Start-End: 305-1579
ggcgattgcaaagcgcgagggctggaactcagacccagaggggcggtccctgttgcaagtcatctcccgaaagggcggggccggggctcatcccggaaggaccggtgtctaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 183262 - DNA, 1755 bp, Homo sapiens
  Payload ID: 16106
  Gene Symbol: SLC22A18
  Gene Name: solute carrier family 22, member 18
  Uniprot ID: Q96BI1
  ENST ID: ENST00000380574
  CDS Start-End: 432-1706
gcgcagcgtcgcacctctgcccaatgaggtgcccctgacgtgcctgctgcggctgccctgctccccccagcctccctgcatcccgggatgggggagggcgccaggcgcagctcccggaccctcaggggtctccccgccctaccccaccagcctgggttcggtacctcggggctcagatgtgcagtcagctgttaatgtggcaaaatttggggaagtcctctgcagccgcaaaatccagttcccaccagttggaggccgggcggggaagggtggggacagacagcactccgctgtgggaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 183263 - DNA, 1225 bp, Homo sapiens
  Payload ID: 16106
  Gene Symbol: SLC22A18
  Gene Name: solute carrier family 22, member 18
  ENST ID: ENST00000449793
  CDS Start-End: 215-1195
tcccggaaggaccggtgtctaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaac

SEQ ID NO: 183264 - DNA, 635 bp, Homo sapiens
  Payload ID: 16106
  Gene Symbol: SLC22A18
  Gene Name: solute carrier family 22, member 18
  ENST ID: ENST00000485423
  CDS Start-End: 233-635
aaaagtggaggagggggaccccctgatgtgtcctctaaggtccaggtagcaggagagctccactggggagggggtcctgcagtgctgtcctctcttgcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccag

SEQ ID NO: 183265 - DNA, 1628 bp, Homo sapiens
  Payload ID: 16106
  Gene Symbol: SLC22A18
  Gene Name: solute carrier family 22, member 18
  ENST ID: ENST00000610526
  CDS Start-End: 305-1579
  modified_base (119)..(119): a, c, t, g, unknown or other
ggcgattgcaaagcgcgagggctggaactcagacccagaggggcggtccctgttgcaagtcatctcccgaaagggcggggccggggctcatcccggaaggaccggtgtttaggtcaccntggagcgctcaccccaccggcaccagtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 183266 - DNA, 1757 bp, Homo sapiens
  Payload ID: 16106
  Gene Symbol: SLC22A18
  Gene Name: solute carrier family 22, member 18
  ENST ID: ENST00000615661
  CDS Start-End: 434-1708
gcgcagcgtcgcacctctgcccaatgaggtgcccaagacatgcatggtgcgggtgccatgctcccccccagcatccctgcatcccgggatgggggagggcgccaggcgcagctcccggacccttaggggttttcccagccaaacctcaccagcgggggttaggaacctaggggctcaggtgtgcagtcagctgttaatgtggcaaaatatggggaagtcatttgcagcggcaaaatccagttcccaccagttggaggccgggcggggaagggtggggacagacagcactccgctgtgggaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 183267 - DNA, 1542 bp, Homo sapiens
  Payload ID: 16106
  Gene Symbol: SLC22A18
  Gene Name: solute carrier family 22, member 18
  ENST ID: ENST00000622105
  CDS Start-End: 219-1493
gacaaaaaaaaaggtctctccgatttcctctgctcaaccagttccctggctacctgaggccctgcttcacctggaggaagacagtggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 183268 - DNA, 1143 bp, Homo sapiens
  Payload ID: 16106
  Gene Symbol: SLC22A18
  Gene Name: solute carrier family 22, member 18
  ENST ID: ENST00000632784
  CDS Start-End: 133-1113
gcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaac

SEQ ID NO: 183269 - DNA, 635 bp, Homo sapiens
  Payload ID: 16106
  Gene Symbol: SLC22A18
  Gene Name: solute carrier family 22, member 18
  ENST ID: ENST00000631887
  CDS Start-End: 233-635
aaaagtggaggagggggaccccctgatgtgtcctctaaggtccaggtagcaggagagctccactggggagggggtcctgcagtgctgtcctctcttgcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccag

SEQ ID NO: 183270 - DNA, 1574 bp, Homo sapiens
  Payload ID: 16107
  Gene Symbol: SLC22A23
  Gene Name: solute carrier family 22, member 23
  Uniprot ID: A1A5C7
  ENST ID: ENST00000380298
  CDS Start-End: 1-1086
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctacccaccccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacaca

SEQ ID NO: 183271 - DNA, 2883 bp, Homo sapiens
  Payload ID: 16107
  Gene Symbol: SLC22A23
  Gene Name: solute carrier family 22, member 23
  Uniprot ID: A1A5C7
  ENST ID: ENST00000380302
  CDS Start-End: 385-1602
aaacagcccccaccctggaagcctcaggtgccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcacccc

SEQ ID NO: 183272 - DNA, 5658 bp, Homo sapiens
  Payload ID: 16107
  Gene Symbol: SLC22A23
  Gene Name: solute carrier family 22, member 23
  Uniprot ID: A1A5C7
  ENST ID: ENST00000406686
  CDS Start-End: 1-2061
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctcgggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcacgcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcacactcagacaccaccgcttcctagagccaaatgagcaatcccaaactgcaagtgccataagtgggcctgtgaggtcacaccgcccggcccgaggtatcgcatgtgcgggggaggtccacactacagctgtcctctcgtctagaaggcaccacctcgctttcatgtcccgtgtgttttggaaaagcagtatggtgtgtcatgtctagcggcgaacacttccctccctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacaga

SEQ ID NO: 183273 - DNA, 6641 bp, Homo sapiens
  Payload ID: 16107
  Gene Symbol: SLC22A23
  Gene Name: solute carrier family 22, member 23
  ENST ID: ENST00000436008
  CDS Start-End: 464-2548
ggaggcgcccgaagtcggagaaatacagcgcggccaccccgggagcagcagcctttgcccgcaccgccgcccgcagggccctgaaccgccggcaagggcgcgggccgggcgcggcgccggctcctcctcctgccgcgtccggcgcggagcagcggagagcggcgggctcggcagccggcgcccgggccgcggaactgatgagccgcggcggctgagggcccggccggcctctgcccgcctctgcccggcgcccgagcggggccgcagcgcccggggcgcggggtccggcgggtgacatgggggcggcctgacgcacccggagccgccgagcgctctctctcgagccgcgggccctcctcggcggcagcggctgcaggcgcctggcccggcgcgctgtgcccggggcgcccgcggagcctccgccgcgctctatgcgcctctgcgggagccgcgggcccgggccatggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagaactgcagctgaagttggccgtagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctcgggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcacgcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcacactcagacaccaccgcttcctagagccaaatgagcaatcccaaactgcaagtgccataagtgggcctgtgaggtcacaccgcccggcccgaggtatcgcatgtgcgggggaggtccacactacagctgtcctctcgtctagaaggcaccacctcgctttcatgtcccgtgtgttttggaaaagcagtatggtgtgtcatgtctagcggcgaacacttccctccctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacagatttcctctggaatgtcttccctacctcacctgatggtatccaccgaagggcatttcactaccattaatggtgagtaataaaatcctccgtgttcattcagacctcactgcgtcactactttgaacgcctctgtaagctgtgtcttcactcgccccgaggtgggtggagggaggcctctcactctgcttcgagtcctggtcttaaaggtagtcagaggcagaggctggattaaacacacactgtttaccaagtgccactctcagaccacctgagagacgggggccatcagtaaaattaagaggaatttttttcccttgttcgtgtatgttctgctgatccgtggcctgaaggttcctagagacgtcaagaaatgaatatcttacactgtgattctgtgaggaaagactggtaacccaaaactctcttctctaatgtattttttaacgaaaatgacaatatttctttaataaagtatttataccaaactcttctctcc

SEQ ID NO: 183274 - DNA, 2555 bp, Homo sapiens
  Payload ID: 16107
  Gene Symbol: SLC22A23
  Gene Name: solute carrier family 22, member 23
  ENST ID: ENST00000497691
  CDS Start-End: 341-619
cttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtattacctgtggctgctttctggctattcacagagttgagtggatgcagcaggatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcacccc

SEQ ID NO: 183275 - DNA, 1574 bp, Homo sapiens
  Payload ID: 16107
  Gene Symbol: SLC22A23
  Gene Name: solute carrier family 22, member 23
  ENST ID: ENST00000485307
  CDS Start-End: 1-1323
aacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgcgtcatgggagacaccccaggggacgccggcttctcggaaatcaaagacgagtccctggctccaggctggtgtgggattaaccagcgtcagctctgtctctggctctggacacatcagcttcgtggttcatagctgaggtggctgttggacccaaccccgaggcgcccaagaggcagtgagaacctggccctggggtcctgtccaggcagcagcaggaggaagggggaacagggagctactctgggcccaggaaatatgtcagtgtctgagcgtctggcaagggggggagtgcagcggatcacttatgccgcacttccaccagaacctgtgctgccaactctgctaagagacctcacggcacagctagtgcaaaatgtttcaca

SEQ ID NO: 183276 - DNA, 1221 bp, Homo sapiens
  Payload ID: 16107
  Gene Symbol: SLC22A23
  Gene Name: solute carrier family 22, member 23
  ENST ID: ENST00000467177
  CDS Start-End: 63-1221
atcttcgtccagggccgcagtggctccggtgcacttagagtcaccctggggaactttcagaaatgcctgtaggaccccagcatccatcgtttaaaagaagttctctggacactttccacgggtgttgtcagcagcaggaaactggagctctcccgtgggacacagacaccaagcgctggaggccggagctgaactgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcgg

SEQ ID NO: 183277 - DNA, 2043 bp, Homo sapiens
  Payload ID: 16107
  Gene Symbol: SLC22A23
  Gene Name: solute carrier family 22, member 23
  Uniprot ID: A1A5C7
  ENST ID: ENST00000490273
  CDS Start-End: 601-1818
gccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccaggcttcttcaaagtctcacagccagcctaccctcaaagcctgagtgattgtggaaggagccagcgttcactcagcagaggaacagagctttcctgccgcaggctctcagtgaagatccagggagcagaggcgtgggcaaggagcactgggctcagatgcaggagaaccggtttgaaccctagcactaccgcctctacactgaggaaccttggggattactcagccccctggaacctaatttccaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaa

SEQ ID NO: 183278 - DNA, 1663 bp, Homo sapiens
  Payload ID: 16108
  Gene Symbol: SLC22A24
  Gene Name: solute carrier family 22, member 24
  Uniprot ID: Q8N4F4
  ENST ID: ENST00000326192
  CDS Start-End: 443-1411
gcaattcactttggattttctaatatcccatttctaagaagaatggcagactattgaacaggtgtattttaggtcacgtggggactgcatccacctgaaaatccaccgttgacttatcaggaaactcagagatcaggatctttcacagagtagtcttttaagaagattcagttgtcaacagctagcagtctctttgccaaataattatatctgtgacttctgaaactatttggctgcctaaagttaaaggacttggggaaagtccttccactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcaatgggctttgatgtgctcctggatcaagtgggtggcatggggagattccagatttgtctgatagctttcttttgcatcaccaacatcctactgttccctaatattgtgttggagaacttcactgcattcacccctagtcatcgctgctgggtccccctcctggacaatgacactgtgtctgacaatgataccgggaccctcagcaaggatgacctcctgagaatctccatcccactggactcaaacctgaggccacagaagtgtcagcgctttatccatccccagtggcagctccttcacctgaacgggaccttccccaacacaaatgagccagacacggagccctgtgtggatggctgggtgtacgacagaagctctttcctctccaccatcgtgactgagtgggacctggtatgtgaatctcagtcactaaaatcaatggttcaatccctatttatggctgggtcacttctgggaggtctaatatatggccatctttcagacagggttggacggaagatcatatgcaaattgtgtttcctccagctggccatctctaacacctgtgcggccttcgctcccaccttccttgtttactgcatactgcgcttcttggcagggttctccaccatgactattttgggaaacacttttattctcagcttagagtggacattgccccggtcacgatctatgacaataatggtgctattatgttcctacagtgttgggcagatgctcctaggagggctggcttttgccattcaggactggcacatattgcaactgactgtgtctacacccataattgtcctcttcttgtcctcttggtatgaacaatctccacattctttgcctgtaagcgaggctatggtagacatagaaaggaaaattctgacacctgggatctgttcggtctctggcctagtcctgagccatgatgtccatagtacctattgtgtcacctgagaagcaaacaatggaataggatgacactatatgtggggaggctggcactttgcattcattattttagacatggaattatcatgaaattatttttcttaatagaaaaaatacccacttatttttgaagcaaatgtattatttatctaacttttggaatattatgtgatggagataatttgggggcttttgtcattgtaactgagattgaatataaggaaaacacaataaatttatctacataactatttaaaa

SEQ ID NO: 183279 - DNA, 2098 bp, Homo sapiens
  Payload ID: 16108
  Gene Symbol: SLC22A24
  Gene Name: solute carrier family 22, member 24
  ENST ID: ENST00000417740
  CDS Start-End: 443-2098
gcaattcactttggattttctaatatcccatttctaagaagaatggcagactattgaacaggtgtattttaggtcacgtggggactgcatccacctgaaaatccaccgttgacttatcaggaaactcagagatcaggatctttcacagagtagtcttttaagaagattcagttgtcaacagctagcagtctctttgccaaataattatatctgtgacttctgaaactatttggctgcctaaagttaaaggacttggggaaagtccttccactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcaatgggctttgatgtgctcctggatcaagtgggtggcatggggagattccagatttgtctgatagctttcttttgcatcaccaacatcctactgttccctaatattgtgttggagaacttcactgcattcacccctagtcatcgctgctgggtccccctcctggacaatgacactgtgtctgacaatgataccgggaccctcagcaaggatgacctcctgagaatctccatcccactggactcaaacctgaggccacagaagtgtcagcgctttatccatccccagtggcagctccttcacctgaacgggaccttccccaacacaaatgagccagacacggagccctgtgtggatggctgggtgtacgacagaagctctttcctctccaccatcgtgactgagtgggacctggtatgtgaatctcagtcactaaaatcaatggttcaatccctatttatggctgggtcacttctgggaggtctaatatatggccatctttcagacagggttggacggaagatcatatgcaaattgtgtttcctccagctggccatctctaacacctgtgcggccttcgctcccaccttccttgtttactgcatactgcgcttcttggcagggttctccaccatgactattttgggaaacacttttattctcagcttagagtggacattgccccggtcacgatctatgacaataatggtgctattatgttcctacagtgttgggcagatgctcctaggagggctggcttttgccattcaggactggcacatattgcaactgactgtgtctacacccataattgtcctcttcttgtcctcttggaagatggtggagtctgctcggtggctgattatcaacaatcagctagatgagggcttaaaggagcttagaagagttgcacacataaatggaaaaaagaatactgaagagacactgaccactgagcttgtgagatccaccatgaagaaggagttggatgcagtccgaattaaaacatccattttttccctgttccgtgcacccaaattgcgaatgagagtcttcggcctgtgctttgtgagattcgcaatcactgtacccttttatggcctgatactcaacttgcagcacttagggagcaatgtctccctgttccagattctctgtggagctgtcacattcacagccagatgtgtttcccttttgacactgaatcatatgggtcgtcgaataagccagatattgttcacgttcccggtgggacttttcattctggtcaacacctttttgccccaagaaatgcagatcctgcgtgtggttttagcaactttgggaattggtagtgtttctgctgctagcaacagtgcttctgtccaccacaacgagctcgtccccaccatattgaggtcaacagttgcaggaatcaatgcagtgtccggtaggactggggcagcactggctcctctgttgatgaccttaatggcgtattctccccacctaccctggatttcctatggagtcttccccatccttgctgtccctgttatcctcctccttccagaaaccagggatctacctcttcctaacaccatccaggatgtggaaaatgaaaaagattcaagaaacataaagcaggaagatacttgcatgaaagtaacacagttttaa

SEQ ID NO: 183280 - DNA, 2101 bp, Homo sapiens
  Payload ID: 16108
  Gene Symbol: SLC22A24
  Gene Name: solute carrier family 22, member 24
  ENST ID: ENST00000612278
  CDS Start-End: 443-2101
gcaattcactttggattttctaatatcccatttctaagaagaatggcagactattgaacaggtgtattttaggtcacgtggggactgcatccacctgaaaatccaccgttgacttatcaggaaactcagagatcaggatctttcacagagtagtcttttaagaagattcagttgtcaacagctagcagtctctttgccaaataattatatctgtgacttctgaaactatttggctgcctaaagttaaaggacttggggaaagtccttccactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcaatgggctttgatgtgctcctggatcaagtgggtggcatggggagattccagatttgtctgatagctttcttttgcatcaccaacatcctactgttccctaatattgtgttggagaacttcactgcattcacccctagtcatcgctgctgggtccccctcctggacaatgacactgtgtctgacaatgataccgggaccctcagcaaggatgacctcctgagaatctccatcccactggactcaaacctgaggccacagaagtgtcagcgctttatccatccccagtggcagctccttcacctgaacgggaccttccccaacacaaatgagccagacacggagccctgtgtggatggctgggtgtacgacagaagctctttcctctccaccatcgtgactgagtgggacctggtatgtgaatctcagtcactaaaatcaatggttcaatccctatttatggctgggtcacttctgggaggtctaatatatggccatctttcagacagggttggacggaagatcatatgcaaattgtgtttcctccagctggccatctctaacacctgtgcggccttcgctcccaccttccttgtttactgcatactgcgcttcttggcagggttctccaccatgactattttgggaaacacttttattctcagcttagagtggacattgccccggtcacgatctatgacaataatggtgctattatgttcctacagtgttgggcagatgctcctaggagggctggcttttgccattcaggactggcacatattgcaactgactgtgtctacacccataattgtcctcttcttgtcctcttggaagatggtggagtctgctcggtggctgattatcaacaatcagctagatgagggcttaaaggagcttagaagagttgcacacataaatggaaaaaagaatactgaagagacactgaccactgagcttgtgagatccaccatgaagaaggagttggatgcagtccgaattaaaacatccattttttccctgttccgtgcacccaaattgcgaatgagagtcttcggcctgtgctttgtgagattcgcaatcactgtacccttttatggcctgatactcaacttgcagcacttagggagcaatgtctccctgttccagattctctgtggagctgtcacattcacagccagatgtgtttcccttttgacactgaatcatatgggtcgtcgaataagccagatattgttcacgttcccggtgggacttttcattctggtcaacacctttttgccccaagaaatgcagatcctgcgtgtggttttagcaactttgggaattggtagtgtttctgctgctagcaacagtgcttctgtccaccacaacgagctcgtccccaccatattgaggtcaacagttgcaggaatcaatgcagtgtccggtaggactggggcagcactggctcctctgttgatgaccttaatggcgtattctccccacctaccctggatttcctatggagtcttccccatccttgctgtccctgttatcctcctccttccagaaaccagggatctacctcttcctaacaccatccaggatgtggaaaatgacagaaaagattcaagaaacataaagcaggaagatacttgcatgaaagtaacacagttttaa

SEQ ID NO: 183281 - DNA, 1692 bp, Homo sapiens
  Payload ID: 16109
  Gene Symbol: SLC22A25
  Gene Name: solute carrier family 22, member 25
  Uniprot ID: Q6T423
  ENST ID: ENST00000306494
  CDS Start-End: 1-1644
atggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgagatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaa

SEQ ID NO: 183282 - DNA, 3699 bp, Homo sapiens
  Payload ID: 16109
  Gene Symbol: SLC22A25
  Gene Name: solute carrier family 22, member 25
  ENST ID: ENST00000528239
  CDS Start-End: 1-607
ggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggaaaccattatcatcgcccaaccatgtctccactgattgtgacgagggacttgaggtgcccattgccatccaccagcatcacgtcttctggtatctctcctgaaaccctgaatgaaaatggcctccatctgcatccatgttgctgcagaagacatgatttcattcttttttgtggctacatagtattccagtctaccattggtgggcattgaggttattccatgcctttgctactgtgaatagtgcttcaatgaacatgtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctgtatgaagtgtctgttgacccctgctgggaagtgtctcccagtcaggaggcacaggtgttagtgacccacttaaggaggcagtctatcccttagcagagctcaagcactgtgctgagagatccactgctctcttcagagctggcaagcaagaatgtttaagtccactgaagctgcacccacagccaccccttccccaaagtgctctgtcccaggtgatgggagttttatctataagcccttgactggggctgctgcctttctctcagagatgccctgcccagtgaggaggaatctagagaggcagtctggccacagttgctttgcagcactgcagtaagttccacacagtttgaacttcccaatggcttccttaacactgtgaggggaaaactgcctacacaagcctcagtaatggtggacattcctctcccaccaaggttgatcatcccagttcgacctcagactgatgtgctggcagtgagaatttcaagccagtggttcttagcttgctgggctccatgggagtgggacctgctgagcgagaccacttggctttctggcatcagccccttctccaggagagtgaatggttctgtctcactgaggttccaggtcccactgggggaaaaaaaaaaaactcctgcagctagctcagtgtctccccaaacagccacctagttttgcacttgaaacccagggccctggtagcattggcacacaagggaatctcctggtctgcgtgttgcaaaaactatgggaaaagcataatttctgggctggatagcacagtccctatggcttccttgggtaggtgaggaagttccctggccctttggacttcctgggtgaggtgatgccccaccctgcttcagcttaccctccgtgggctgcacccacccgctgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgcttttaaaataaataaataaaccccatagcacatcctccatacaacatctgttgtccctcaagatacaattgttaccactatcatctaaccattattttatgataactttaaaatatcaacttgcaagaaaatattccacaaaacacactctgcctttttactttaaagagtccttggctacctgggccaatattattctcatttgtaggatttaggttccacagattataatatgtgcctttttctgtgttccctgcagatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgcta

SEQ ID NO: 183283 - DNA, 1788 bp, Homo sapiens
  Payload ID: 16109
  Gene Symbol: SLC22A25
  Gene Name: solute carrier family 22, member 25
  ENST ID: ENST00000527057
  CDS Start-End: 1-1198
ctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgcta

SEQ ID NO: 183284 - DNA, 1362 bp, Homo sapiens
  Payload ID: 16109
  Gene Symbol: SLC22A25
  Gene Name: solute carrier family 22, member 25
  ENST ID: ENST00000525295
  CDS Start-End: 1-471
atggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtg

SEQ ID NO: 183285 - DNA, 1909 bp, Homo sapiens
  Payload ID: 16110
  Gene Symbol: SLC22A31
  Gene Name: solute carrier family 22, member 31
  ENST ID: ENST00000562855
  CDS Start-End: 1-1671
atggagcaggaggcgcgggtgctgagagctgcgggcggctttggccgggcccggcgcctgctggcctccgcctcgtgggtaccctgcatagtgctggggctggtgctgagctccgaggagctgcttaccgcgcagcccgcgccccactgccgaccggaccccacgctgttgcccccagcgctgcgcgccctgcgcggacccgcgctgctggacgccgccatcccgcgcctggggcccacgcgagcccccgccgaggccctgggtgtcctttctccatcctacctggcgcctctgacccgggccccccggccgtcctcctgggcttcctgctccggggcggccgccggcccgacgtggaaccttgtgtgtggagacggctggaaggtcccgctggagcaggtgagccacctcctgggctggctgctgggctgtgtcatcctgggagcaggctgtgaccggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttctgtggaa

SEQ ID NO: 183286 - DNA, 1860 bp, Homo sapiens
  Payload ID: 16110
  Gene Symbol: SLC22A31
  Gene Name: solute carrier family 22, member 31
  ENST ID: ENST00000614943
  CDS Start-End: 606-1622
agagctggccgtgggggaagagcaatggtgtgcggaggtgggggaggccctatctagggacaagcagaaaacttagggtgggcagatccccccgacccctgtgcaggggctgccggagaccagagaggctgctgtgtgacctggaccaagccccttgccctctcatgcctcagtttccccttctctccacggagggattgagcaggacatggagggccccttccagtagccattctgggactccctgcacctgtccccaggggagggtcctgagctggcctccacgtggctgctgttccccatagtggaaccttgtgtgtggagacggctggaaggtcccgctggagcaggtgagccacctcctgggctggctgctgggctgtgtcatcctgggagcaggctgtgaccggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttctgtggaa

SEQ ID NO: 183287 - DNA, 2299 bp, Homo sapiens
  Payload ID: 16111
  Gene Symbol: SLC23A1
  Gene Name: solute carrier family 23 (ascorbic acid transporter), member 1
  Uniprot ID: Q9UHI7
  ENST ID: ENST00000348729
  CDS Start-End: 48-1844
gtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaataa

SEQ ID NO: 183288 - DNA, 2303 bp, Homo sapiens
  Payload ID: 16111
  Gene Symbol: SLC23A1
  Gene Name: solute carrier family 23 (ascorbic acid transporter), member 1
  Uniprot ID: Q9UHI7
  ENST ID: ENST00000353963
  CDS Start-End: 40-1848
ctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtgggtttgcatgtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaataa

SEQ ID NO: 183289 - DNA, 406 bp, Homo sapiens
  Payload ID: 16111
  Gene Symbol: SLC23A1
  Gene Name: solute carrier family 23 (ascorbic acid transporter), member 1
  ENST ID: ENST00000504513
  CDS Start-End: 1-406
gcccctgaacacctctcatatttggcacccacggatacgggagctccattctcctgatcatcctcttctcccagtacctgcgcaacctcaccttcctgctgcctgtctaccgctggggcaagggcctcactctcctccgcatccagatcttcaaaatgtttcctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctg

SEQ ID NO: 183290 - DNA, 509 bp, Homo sapiens
  Payload ID: 16111
  Gene Symbol: SLC23A1
  Gene Name: solute carrier family 23 (ascorbic acid transporter), member 1
  ENST ID: ENST00000508270
  CDS Start-End: 1-509
aaactggtccagcaactttggaaattgggagcagtagccaagagggagaggagaggacaggcggacagaggaacagtgtggacaccggcaggcgggcggactcagtgctgtggcatgaagctgctgcccagctggagagcggtgctgccccttggcccttcaggcagggcctggccatgggcacagcgacccagaagaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcat

SEQ ID NO: 183291 - DNA, 6944 bp, Homo sapiens
  Payload ID: 16112
  Gene Symbol: SLC23A2
  Gene Name: solute carrier family 23 (ascorbic acid transporter), member 2
  Uniprot ID: Q9UGH3
  ENST ID: ENST00000338244
  CDS Start-End: 376-2328
ggcggctgtcgcggggaccggaggcggaggctgcagcgggcactgcggcgccgaggcgcggcggcaggacgggaaccacgcgagctgcagccagctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagt

SEQ ID NO: 183292 - DNA, 6962 bp, Homo sapiens
  Payload ID: 16112
  Gene Symbol: SLC23A2
  Gene Name: solute carrier family 23 (ascorbic acid transporter), member 2
  Uniprot ID: Q9UGH3
  ENST ID: ENST00000379333
  CDS Start-End: 394-2346
cattcatcttctcctgcccttggacatcacagctccaggaactcagatcttcagactcagggtgaaggacaccaccagctttccaggttccccagcttgcagacggcatacgctaggtcttgactccactaacggggacttctcatacggctttgaacttggaccttggtgcataagcaaatgtaactcagcgaattgtaatggaaagcatatggacaggtctacgccacatcacttaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtggtgataaatggaggcgccacctccagcggtgagcaggacaatgaggacactgagctcatggcgatctacactacggaaaacggcattgcagaaaagagctctctcgctgagaccctggatagcactggcagtctggacccccagcgatcagacatgatttataccatagaagatgttcctccctggtacctgtgtatatttctggggctacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggttacccctgtttcaggccagtgcttttgcatttttggcccctgctcgagccatcctgtctttagataaatggaaatgtaacaccacagatgtttcagttgccaatggaacagcagagctgttgcacacagaacacatctggtatccccggatccgagagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatcaagtgttgaacgtccttctcacaactgctatgtttgtagggggctgtgtggcttttatcctggataacaccatcccaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagt

SEQ ID NO: 183293 - DNA, 911 bp, Homo sapiens
  Payload ID: 16112
  Gene Symbol: SLC23A2
  Gene Name: solute carrier family 23 (ascorbic acid transporter), member 2
  ENST ID: ENST00000423430
  CDS Start-End: 1-911
ggggtacgaccagtgggccaccagccagctcattgggaccattttcttctgtgtgggaatcactactttgctacagacaacgtttggatgcaggacaatattcctagtattactgttttctcaatacgccagaaatgttaaatttcctctcccgatttataaatccaagaaaggatggactgcgtacaagttacagctgttcaaaatgttccctatcatcctggccatcctggtatcctggctgctctgcttcatcttcacggtgacagatgtcttccctcccgacagcacaaagtatggcttctatgctcgcacagatgccaggcaaggcgtgcttctggtagccccgtggtttaaggttccatacccatttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggggaattttcgtggaaggcctctcctgtgttcttgatggcatatttggtactgggaatggctctacttcatccagtcccaacattggagttttgggaattacaaaggtcggcagccgccgcgtgatacagtgcggagcagccctcatgctcgctctgggcatgatcgggaagttcagcgccctctttgcgtcccttccggatcctgtgctgggagccctgttctgcacgctctttggaatgatcacagctgttggcctctctaacctgcagttcattgatttaaattcttcccggaacctctttgtgcttggattttcgatcttctttgggctcgtccttccaagttacctcagacagaaccctctggtcacagggataacaggaatcgatc

SEQ ID NO: 183294 - DNA, 2037 bp, Homo sapiens
  Payload ID: 16113
  Gene Symbol: SLC23A3
  Gene Name: solute carrier family 23, member 3
  Uniprot ID: Q6PIS1
  ENST ID: ENST00000295738
  CDS Start-End: 112-1593
accctctccccaccttctccccaccccaggcttcacccaaactctgacctcttactctctctacttaactctggtcccgggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctcacctgggctcctgccagtttcatgtgtgcccctggaggcgagcttcaacgtcatcaactcacactcctctccctgtcttccggctcctttcggaactgtctgcccccaccaaggcaccatggatttggctgcctcacccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatagggtgggttgcctttccttgtcttaattaggcctaactgttccagagcagaggccatgatttagtggaccatgaatgattgagattttgcctgtgtactatcaatgccacttgaaccccagcattcactttaatacttactgagcatctcccatgtgcaaggtcctggaactacagggataagacagggtccatgccgtctcaaggcatttacggtttaaaaagacctttgtaattactaacgaaaatgcaaagcagaaagcagtctgtaataaagattaaaataatgccgtgggagcaaa

SEQ ID NO: 183295 - DNA, 2010 bp, Homo sapiens
  Payload ID: 16113
  Gene Symbol: SLC23A3
  Gene Name: solute carrier family 23, member 3
  Uniprot ID: Q6PIS1
  ENST ID: ENST00000409878
  CDS Start-End: 34-1866
gggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccaggtgagtggaattggcctttgctgacgcccagagctctggctgcaggcatctccatggccttggcagcctccaccagttccctgggctgctatgccctgtgtggccggctgctgcatttgcctcccccacctccacatgcctgcagtcgagggctgagcctggaggggctgggcagtgtgctggccgggctgctgggaagccccatgggcactgcatccagcttccccaacgtgggcaaagtgggtcttatccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatag

SEQ ID NO: 183296 - DNA, 785 bp, Homo sapiens
  Payload ID: 16113
  Gene Symbol: SLC23A3
  Gene Name: solute carrier family 23, member 3
  ENST ID: ENST00000409370
  CDS Start-End: 7-785
ggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctggttatcctgctcatggtggtctgttctcagcacctgggctcctgccagtttcatgtgtgcccctggaggcgagcttcaacgtcatcaactcacactcctctccc

SEQ ID NO: 183297 - DNA, 559 bp, Homo sapiens
  Payload ID: 16113
  Gene Symbol: SLC23A3
  Gene Name: solute carrier family 23, member 3
  ENST ID: ENST00000430764
  CDS Start-End: 21-559
aaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtgcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgct

SEQ ID NO: 183298 - DNA, 603 bp, Homo sapiens
  Payload ID: 16113
  Gene Symbol: SLC23A3
  Gene Name: solute carrier family 23, member 3
  ENST ID: ENST00000414999
  CDS Start-End: 1-34
atgtggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctgtacggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccagg

SEQ ID NO: 183299 - DNA, 2048 bp, Homo sapiens
  Payload ID: 16113
  Gene Symbol: SLC23A3
  Gene Name: solute carrier family 23, member 3
  Uniprot ID: Q6PIS1
  ENST ID: ENST00000455516
  CDS Start-End: 49-1905
cttaactctggtcccgggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactgtgagcacagagcaagggcaagggcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccaggtgagtggaattggcctttgctgacgcccagagctctggctgcaggcatctccatggccttggcagcctccaccagttccctgggctgctatgccctgtgtggccggctgctgcatttgcctcccccacctccacatgcctgcagtcgagggctgagcctggaggggctgggcagtgtgctggccgggctgctgggaagccccatgggcactgcatccagcttccccaacgtgggcaaagtgggtcttatccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaata

SEQ ID NO: 183300 - DNA, 5768 bp, Homo sapiens
  Payload ID: 16114
  Gene Symbol: SLC24A1
  Gene Name: solute carrier family 24 (sodium/potassium/calcium exchanger), member 1
  Uniprot ID: O60721
  ENST ID: ENST00000261892
  CDS Start-End: 288-3587
cccttcacacccgaccctgccttgaattaggattccataggagagctgggggcaggagaatggggtgttccctgctgtccagcttcagacccactctttgagatattggattctgacaagtttccagagctgagaagacagccagatgtcaaggtctgaagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagccgggcgatggggccattgcggtggatgagctacaggataacaagaagctgaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtattttctttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctga

SEQ ID NO: 183301 - DNA, 5678 bp, Homo sapiens
  Payload ID: 16114
  Gene Symbol: SLC24A1
  Gene Name: solute carrier family 24 (sodium/potassium/calcium exchanger), member 1
  Uniprot ID: O60721
  ENST ID: ENST00000339868
  CDS Start-End: 288-3497
cccttcacacccgaccctgccttgaattaggattccataggagagctgggggcaggagaatggggtgttccctgctgtccagcttcagacccactctttgagatattggattctgacaagtttccagagctgagaagacagccagatgtcaaggtctgaagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagccgggcgatggggccattgcggtggatgagctacaggataacaagaagctgaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtattttctttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctga

SEQ ID NO: 183302 - DNA, 3323 bp, Homo sapiens
  Payload ID: 16114
  Gene Symbol: SLC24A1
  Gene Name: solute carrier family 24 (sodium/potassium/calcium exchanger), member 1
  Uniprot ID: O60721
  ENST ID: ENST00000399033
  CDS Start-End: 83-3292
tgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagccgggcgatggggccattgcggtggatgagctacaggataacaagaagctgaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatgga

SEQ ID NO: 183303 - DNA, 3246 bp, Homo sapiens
  Payload ID: 16114
  Gene Symbol: SLC24A1
  Gene Name: solute carrier family 24 (sodium/potassium/calcium exchanger), member 1
  Uniprot ID: O60721
  ENST ID: ENST00000546330
  CDS Start-End: 1-3246
atggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctga

SEQ ID NO: 183304 - DNA, 3983 bp, Homo sapiens
  Payload ID: 16114
  Gene Symbol: SLC24A1
  Gene Name: solute carrier family 24 (sodium/potassium/calcium exchanger), member 1
  ENST ID: ENST00000537259
  CDS Start-End: 625-3663
attgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctgaactacaaatcctggccgggcgtggtggttcaggcctgtaatcccagcactttgggaggccaaggtgggcggatcgcttcaggtcaggagtttgagaccagcctgggaaacatgacctagttatgcttgagcaggcattgggctccaggcctctggccgctccagaagggcacttgactgtaaggatgaaatcctgtctctgagctgcactcagtgtgaagtgccaccacctgcatccccctgtctcagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggagttggaagctgtgaaatgtttcagcatggtgctattcactaatggtgtgaactcaaaagattctacagacttcagattctgaagcttgttgaaaaagctaagttcctcaatatggatgaaaatctatctggctgtacttttagaggggaatttttctacttttgaaaaaaattctgaatatttatatatagtattaacagaataccccagtaagtcatatttcagataaatattctatagtataatttgcatcatacccaatattttagatattaaaataagggtaaaatttggaatataatcacttgtctgcatatttcccaatgtaagttttcatgtagaatattaaaatttaaattgat

SEQ ID NO: 183305 - DNA, 3169 bp, Homo sapiens
  Payload ID: 16114
  Gene Symbol: SLC24A1
  Gene Name: solute carrier family 24 (sodium/potassium/calcium exchanger), member 1
  ENST ID: ENST00000544319
  CDS Start-End: 211-3168
tccagcttcagacccactctttgagatattggattctgacaagtttccagagctgagaagacagccagatgtcaaggtctgaagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaa

SEQ ID NO: 183306 - DNA, 854 bp, Homo sapiens
  Payload ID: 16114
  Gene Symbol: SLC24A1
  Gene Name: solute carrier family 24 (sodium/potassium/calcium exchanger), member 1
  ENST ID: ENST00000505666
  CDS Start-End: 1-170
ctcgaaaaggcctgggagacatggctgtgtcaagctctgtgggcagtaacatatttgatatcactgtgggagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaa

SEQ ID NO: 183307 - DNA, 2170 bp, Homo sapiens
  Payload ID: 16115
  Gene Symbol: SLC24A2
  Gene Name: solute carrier family 24 (sodium/potassium/calcium exchanger), member 2
  Uniprot ID: Q9UI40
  ENST ID: ENST00000286344
  CDS Start-End: 63-1997
tgaaagaaccatctggttgagtctaaagttggaagatcaccatatccaccagaagacccaggatggatctgcaacaaagcaccaccatcacttccctagagaaatggtgtttggatgagtcactgtctggctgcagaagacattatagtgtcaagaaaaaactgaagttaattcgagtcttaggccttttcatgggtctggtagccattagcactgtctcattttcaatcagtgccttttctgagacagatacacagagcacaggagaggccagtgttgtaagtggccctagggtagcacagggttaccatcagagaactctcttagatttaaatgacaagattctggattatactccacagccacctctttctaaggaaggcgagtctgagaatagtacagatcacgcccaaggagactacccgaaagacatcttttcccttgaggagagaagaaaaggtgcgatcattctgcatgtcattggaatgatctacatgttcatagccttagccattgtctgtgatgagttctttgttccttctttgactgtcatcactgaaaaactgggcatctctgatgatgtggctggagccaccttcatggctgcaggagggtcagccccagaacttttcacatctctcataggggtatttatcgctcacagcaacgttggcataggcacaattgtaggttcagcagtattcaacatcctctttgttattggcatgtgtgctctgttttctagagaaatcttaaacctgacatggtggccgctctttcgagatgtgtctttctacattgttgacttgatcatgctgatcatatttttcctggataatgtcatcatgtggtgggaaagcttgcttctcttaacagcttatttttgctatgtggttttcatgaaattcaacgtccaagtagaaaaatgggtgaagcaaatgataaaccgcaataaggtcgtcaaggtgacagcaccagaagcccaagcaaagccatctgcagccagggacaaggatgaaccaactctaccggctaagccgcgtctccagcgaggtggaagctctgcctccctccacaacagtctcatgaggaatagcatcttccaactcatgatacacacccttgacccactcgccgaagggaggttcagagaaaaggcttcaattctccacaagatcgccaagaagaaatgtcatgtggatgagaacgagaggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacagg

SEQ ID NO: 183308 - DNA, 10749 bp, Homo sapiens
  Payload ID: 16115
  Gene Symbol: SLC24A2
  Gene Name: solute carrier family 24 (sodium/potassium/calcium exchanger), member 2
  Uniprot ID: Q9UI40
  ENST ID: ENST00000341998
  CDS Start-End: 63-2048
tgaaagaaccatctggttgagtctaaagttggaagatcaccatatccaccagaagacccaggatggatctgcaacaaagcaccaccatcacttccctagagaaatggtgtttggatgagtcactgtctggctgcagaagacattatagtgtcaagaaaaaactgaagttaattcgagtcttaggccttttcatgggtctggtagccattagcactgtctcattttcaatcagtgccttttctgagacagatacacagagcacaggagaggccagtgttgtaagtggccctagggtagcacagggttaccatcagagaactctcttagatttaaatgacaagattctggattatactccacagccacctctttctaaggaaggcgagtctgagaatagtacagatcacgcccaaggagactacccgaaagacatcttttcccttgaggagagaagaaaaggtgcgatcattctgcatgtcattggaatgatctacatgttcatagccttagccattgtctgtgatgagttctttgttccttctttgactgtcatcactgaaaaactgggcatctctgatgatgtggctggagccaccttcatggctgcaggagggtcagccccagaacttttcacatctctcataggggtatttatcgctcacagcaacgttggcataggcacaattgtaggttcagcagtattcaacatcctctttgttattggcatgtgtgctctgttttctagagaaatcttaaacctgacatggtggccgctctttcgagatgtgtctttctacattgttgacttgatcatgctgatcatatttttcctggataatgtcatcatgtggtgggaaagcttgcttctcttaacagcttatttttgctatgtggttttcatgaaattcaacgtccaagtagaaaaatgggtgaagcaaatgataaaccgcaataaggtcgtcaaggtgacagcaccagaagcccaagcaaagccatctgcagccagggacaaggatgaaccaactctaccggctaagccgcgtctccagcgaggtggaagctctgcctccctccacaacagtctcatgaggaatagcatcttccaactcatgatacacacccttgacccactcgccgaagaacttggatcatatggaaaactaaaatattatgacacaatgactgaagaagggaggttcagagaaaaggcttcaattctccacaagatcgccaagaagaaatgtcatgtggatgagaacgagaggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacaggctgcttccaccctgcctactgaaatgacttcatgtaaaagacaaagagaaccgtcaatacagggcttctccctattcaccactgacaagtacacctcgctggtcggaggtacagtcgatgcaaacaaggacacaggctatatatatctataaatacacatattataaatatacgcacatgaacacacaaatcctgcctgttcctgtactatacctctccttgcatacctatagattagtacatacctgtaaataaagacaaagaaaaattatatatatatatataaaatcagatatatataaaagtacaaatgcatcttttcagggatagctctagtatatttatagtacttatttgaagaggggcatcaacttgcagtctgggctttacctcttaagtacaagaggtgaactaatggaaccaacaagacaaaggtagcattgctgtgaccttcagcctaccttggacttgctgtgatcctgcctagtaaggtagatggtttagggaaatagcttgcagggaggagggcttagtggagaaggtctgtaggggccctgagttgagccttccaaaacattcctacaagccaaacagagagactatctgcccacctccaccagagtaccctgaccaagaaactcagggtacttaggacagaaagaggtaaaaacccaggctgggtggcttggtttggggaagtggggaggtaaccagggttgggttgttttgttttgttcttatattgtcccagcatgcaagtagaaaatatgactacaaaccaaattagtgctttttctaggacagcaagactatataaactgaacctgtatttttccagcgcatgtcccattatcatcaaaagaagaggggtaagtttagctgtgattgtcatgtagatatattttgatgctaagggctgccaagagagcctagatgtgcaataagaagtcatccagtaaaggtgcttagtgggccttgccacctaatgggatgtaagggcatagttctttaaaacgttttccagtgtagtcataaagggctttagtgtctgaagaaatcattattcccaatagcactaacttaactctgatcagcactgcttgggttgaggcaacttagcgatgcttggaaaggcatttgcacactcagtgcaccccaggaaggtttctgagtgccaggtcgagtggtaccaggaccaggctttggttaaagttcttgtaacatctatgtctcttcttccatcaagaccttatctgggattctgtctaagttttagagtacacggtatttgacagcttccttatactggtttcaagctattcactccaacaatttgatttcttgattttgctcaacattacattgaatgcatgaaattaaaatattccacgcccccaagttctgtatgacaccttgtgtgttttctcagatctatgtcagtcgaaaataaagccagcaagggggaaaaaataggcaaactgaatcaatggaaaactatgtagagcacttttcttttctccaagtcatgctttccttaaaatcagttgaaaaattgaatcaaggatggttcattattctgtacccatcctacgtctaagttggtacatatggcatatgggaaatttcaccatatgtgttcctatctccaatctattctgtcattgacgcctgctatgattttgttgtgagcacatacctcttaacataagaggacaggatgcagaactcacagcagaataagaggaaaggtaacctgacagccccagatcaagctcagtattccttccagaaaacctcagctcaccccacagagcatggcaataacaggaaatgcccatcattcctcttcacccagaagtaaaaagcacttcaaacccgaggccccctgggaaaacaagaaatcaagatggctgccagtcggaggctggctttcaagtctctccaactcggcagattggggtcttcagatgtgggacaatgccttccaagacattgaaacaccatccaatagaggcgctgagtggaacctgccacctaatgggaatgaatctcattcatcaaggtcaggactttgtactggggcaagaatttgtcctgcttccttagagagtgaaagaatgaggaagtgaactttacgtttaaaaactccagttgttttccctgtgtatttcttgaagggcaaccaagttggttattgtgtgaattttatattattgactggtgcgttgtttgaaataaggtttaaataggtgactgactcaactgcaaacagaccatgtaaaacagaagttgaaggagacctgatgccgccctcttcttattcctgatcctccctctgcctcctcactccctcccatttattcccagcttacagtgaaggctgatcaaagcagctatggtgccctttgcttgtctcggagctccacttcacaggaagtgttgtggtctttcatgtgaagttgcatttgagaagacaaaatttccaagccccgttcccacatcagtcatgtgcactgagcctgacctacaacagcactgctccctcactggatgggacacaagtgattccacagcctgcccttgctttcccttcatttctgtgtctgtaagtggttatgtgttgagccagggtaaattcagagagatgtgtacagagttcaacaatgggtctttaaaccattcaaatcattggcataattataagaactttccacaccgtggtttccaaaacaggtcatctctaactcgtttcctgcatgcctgtgtatatacatatataaatatatacatatatatatatatacatatatatatatatatatatatctttataccagatctatatgtacacatataatatgacttacatcatcaccctctgaccctatcacattcaggattctaaagcagggagcatcaagtttgccaaagtcaaggaaaaggaaagtcatgcacacaaaccaaagggaacatttcttcctgatttcataaggttgtttgttccatgcacatatatttacaaatatacacatatgtacccatattttcccaccctaagaatatcaatttatagccttaaggaaatcggtcagccatatccctaatgctgatatagaggcaaagaatacacaacagaaaatacaaagcaaaaatttagactgcagatactctctttgcttctctggagcagggtataaaagatatcaacaattcaagagccaacattgtactaatcaatctaaaataaatgagttgcacgcaaatgatttcatttattcacagcaaaccgagcaggtcttgcttgctgtcaccgcctaccctcccccatacttccaaggcagcagagcagcttggctcaaactgacaattcccaaatagaaactcctaaattgcatctgagaatgcccatgccaactccagctgccctctgcacctgaccagatcctgatgaactgaagctgaagatcagatggtgtttatgcagcttcccaggacctaaactgagtcaggcagtgacagagcaatgatatatgcagggactaagggatagggttgtttataccctcggcagatgcagcagaatgtcctaaagccttgcccagaagattataaaaagaggcggagactgttttatattcaggaaaaatgctttgtaaggcttctaacaggtgtcacctgacaagggccatcataatttattttatagggaagacatgaatcaggtggtttggagccctttcagcaaaacgcagctgcctcgctgattagacatttgacaatgttaatgtacatccattcctgggcagggagagagttggcaaactccccaccactgcacatagcttttaaaggcctctggaacagtgagagaagagatgagctacaaagggagcccacccccagaccactttaacaaaaagttgaccaaagaaaagacacctggtagagtggctggccagatagagctgaagaagatggaagttgcattaaatgctctgcagaaattactgcgttggactatctaacatgggtctgatggcaggcatttcagaacatggcagtgtgctttcctccccacatctaccaaacacacacccacacccccacacacacgcgagattatgtggatgctatgcctccttgcacctggacagattgtttttctggtaagtaggtggccctattataggtggcagctgtgttccagaagaaacaaagtgaagctgttctcagggtgatttctggagaaaactactgtctcctgaaagcatgcatagaagtcagtgctcactcttgctaagccacatattccttaacgatccggcttaatatttttaaaagatacctcctcaacccctatacctgtctcaacaatactgtcttcaattattaggtaaggccttgtcattaagagaggggtaggagaaaaaatagaataataaggaaagggaagaaaggagatattaatttcctaggattccaagaaaacaagtgtcacgtggaaatatatccctatgtagtttaaaacagtaacaaatatcaggctatgtttagccaattacaagagcccatatacagttttagatttttttaaaaaataatctcaggaagaccttgggtaagaaaagtaaccctgccctattccaccttctatttactgttagctccctgactctgcctctgcctctgtctttgcgtttcatttttaatctcagagcttcatattttttaaatatatagcaaacaagaaaagcaataagggaactactcacagccagctcaactctattacttatgattacaccatggcaatattcctttttcaccaggagctttggacctgcgcaggttgtggcatgtaatcacccggagcatgtagtcgtctgtagaaatcacaggcacactcatgtttgctctggaaggaatctgttttccacaatgactccccccagctaatgtacacactggcattttgcatgccttcctcacacatggggcaccagccttgctcagaaccacccaaactccacagaggcccttaatatggctagggacagatttcttaagaaagagtaagaagcagctacaaaggacaagcaaatccacaagtcaggcagcattcgagaggcaaaaatgaccctgcaattacgacaggctaggcaactgttttcaaattagcgtacgaacagtgagggactgtgtagagcaccatattatctaagccaaagcacttctaccagatcattcattgacagactggaaaacctaataaaatctttaaaaacagacaaatatctaagtctgaaagaatgccatggagtttgcctaggcttccaccaaagatttaattccattaagagggtttgtctagcctatcacgctaatccaaaggacagtcctcttacgggggagatcccagcatagatgctggtgtgacccagctcaatgattaacaaccatcagcatcaagaaaagcctccctccaagttaacccaaacccatccacttaatgacttaactttttttttttttttttttttttttggcaaaaagtaactgcatctgggcactcttcactctttgccccatagttggaagttaccgctatgtgactctttacctattttcaattaaaattatctttagatttttatttgagtctttaaccctcttaataatttttatagttcctctctactaagcctttttaagttctttatattgttcttaaatgatggaaccttatgactaatgataatcactgtctgaacagtgttgaactatactgggtgcagcatgaccatgaagctctggtgaagtcaaggtcacaaactgcttttaaggtcattaggtcataatctcagactcacaaagaactcaaaattggggagacaccactttagattactccaaaactctgggcctgtacttacccactaatttatcaagaggaatcaatatttttattttaaatatgaaactgggataaatgattggatctccacttattaaccagtactgcagtgtgtttatatccttttgtgtggtaggttggataggatttgtaaagctactgattgatctcatgggccagggttcaccaaaaggatgggaatttgtttctgcattcttacatattgggttgcatattccttcataatggatccataagtaactaaggccttggagactaacagttctccaaaatactcagctaaccaaaagaaaatactaatttttaaaatcatgtcataaaaaacagaaaagtaaaaaaagtctgaaatcctgaataaaattattttaaggatgaaattacatgcataaattaagggtagataacttcttgccatttaattaaacaaatccccaattcttatcagaataaaactgaaggacaatggatgccttttgggttttttaattttttaatattgcactttatagtacttcataagagacaactgtcttaattaaagccataaaataccaataatacatatattcagggcttctgaatatagtcaatcaataagcagtccatgagtcattcctgttttgtattgtttattgtaaattggagtttatctgttctattttttattaactacaattattgttctaggcaatcctaatctacttatacattttagatgtgtgctttaataaaactgtttgaaaatcaaagaaattattcatttcacaaaagcagtcttcgttttcaaaatagcttattacagtttctttagcaagttctaatactacatggaaattattttaaaattgtagatttttttcaggaatccattttgttatataaagcaaagttcacccatatggaaaatgaaatagataattagcaaacatatacctgggaaatgtaggatgtgtttgagcttttatataaatataggatgggtctaagaagttcccttataaaaatgggaaatagaggtatacaatttatcaataattccttatgcctaaattactaaccttccttgggaggacatgtaaagcagcagatttcataatgctttggtggttattttcctcctctccgctaaaatacacaatttctaacctagtatggtacactgtttacacacacatatataaagatgtccccacaactaaaaactttaatgtttcaacttcatcacaaatttttatataattttttttttaacagacagggtcttgctctgtcacccaggctagagtgcagtggtgcaatcatagctcagtgtagcctcaaacacctggactcaagcgatcctcccacttcagcctcttgagtagctgggacctcaggcacatgccaccatgcctggctaattttgttgttgttgttaagagatggagtctcactatgttacccaggctggtctcaaactcctgggctcaagagatcctcctgctttggcctcccaaagtgctgggattaaaggaatgagccaccatacccagcccttttatgtaatttgagtaaaagtaattactaaaaagcacttaatagtctagaaatccaccagaactgggtacctaaattgtccatatagagtaaacatgggtactaaactggacaaccccatcaattttatgcttaagtggccaaattgccctaaagaaagggtatctgaaccaagggccagtgatattcctctgttagaggctgttttgtggtctgaagagtttctctaaagggctgagactctattcggaagagggagcctcagttactgaattgcgctattgaaccctgaacacaaagtacacatatataccctgcatctagccttgatatttcttctgctcaagtcaaaaaactccggaagcaacagcttccaccatcaagcaatccacatacttaaaaagccatcaaagctaagaatagcaaaagctaccttcctgattcagtgaagttgctgctagcactaaaagcaagagaaattatacttttgttcttcagatacggttaaaacaaagaaaatgttgtcaacgttgacgccaacatagacatttgctctataacatataaactgtcttttagacaggttatgttaaaaatatcagaatgccatttttgtaaaggatcttttttaggatagacgtggtctcatgcttcctttgttcgcctccgttttaaaggagcattgtaacccctatcctcatccctacaaaaatccagtggatgcacttccaaattacttctgtcattttgtatgtgttgtgtttattatgcgtaattttcactggatgatgagatacatggtgatactatgtcagtttattctctgtgaatatgtctgtacatagacaggaagctctacttatttgtacataggctgtctgaagtatgtacttctgtcacatggacttcattctgataaagggtgtttcttcttgtttcactgtccatacctttgtgcttctactactgataatcaattcatagaatatcactttatgtaactaagtctcctcagtgtgaaaaataatagtaataaaattattgactcaaagaagta

SEQ ID NO: 183309 - DNA, 3929 bp, Homo sapiens
  Payload ID: 16116
  Gene Symbol: SLC24A3
  Gene Name: solute carrier family 24 (sodium/potassium/calcium exchanger), member 3
  Uniprot ID: Q9HC58
  ENST ID: ENST00000328041
  CDS Start-End: 198-2132
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatccttcccagagcagagtgcattactttctcccctggaaa

SEQ ID NO: 183310 - DNA, 3694 bp, Homo sapiens
  Payload ID: 16116
  Gene Symbol: SLC24A3
  Gene Name: solute carrier family 24 (sodium/potassium/calcium exchanger), member 3
  Uniprot ID: Q9HC58
  ENST ID: ENST00000613834
  CDS Start-End: 1-1935
atgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccggccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatc

SEQ ID NO: 183311 - DNA, 4417 bp, Homo sapiens
  Payload ID: 16117
  Gene Symbol: SLC24A4
  Gene Name: solute carrier family 24 (sodium/potassium/calcium exchanger), member 4
  Uniprot ID: Q8NFF2
  ENST ID: ENST00000393265
  CDS Start-End: 118-1794
gggcccgcagatctctctggttcccctctctgccccgtctccagcttttttgcagggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 183312 - DNA, 9950 bp, Homo sapiens
  Payload ID: 16117
  Gene Symbol: SLC24A4
  Gene Name: solute carrier family 24 (sodium/potassium/calcium exchanger), member 4
  Uniprot ID: Q8NFF2
  ENST ID: ENST00000532405
  CDS Start-End: 227-2095
gcacgcggcgcgcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgccgctcggccactgattgcactctggccgctgaagctccccatcctctcccagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaactatatgtacactgtaggtggaaaattctcttttttaactaaatatttttccatcacaaatttaaagaattgcatgattaattaggctttcatttttaaattacgctttcatcactacgcaggattactttattttattcccaaagctcattagcatgggataattactctgctacagaaataggcaatttaaaaaaatgaatttagctcttctcattgggggcagaaaagaaaaaaaaaaccattgcactcagatggaaaatgcctatagacacaggagcaggtggttcctgtggacttctggtttggaattttgcctcaccaggtcaagcgtggttagggtggaaggtgtccagtatcttgaaaacctggccctggaggaaggttctgggtcagctgcaatgagagactggtgattaagggcaccgtgggcaggacacagtcctcgccttacccaccccatccttcctgttacccacagtctgctggcctccatgcctcttccccttgtcacttgtgtctcctccttatgcacagagctgcctgcctttatgaattttcttttcttttttttttgagacagcgtcttgctgtgtcacccaggctggagtgcagtggtgccatcttggctcactgcaacctccgcctcccaggttcaagcaattcttgtgcctcagcctcctgaggattacaggcgtgcgccaccacacccagctaatttttgtatttttagtagagacgggttttcaccatgttggccaggctggtctcaaactcctgacctcaggtgatccacccacctcggtttcccaaagtgctgggattacaggtgtgagccaccacgcccagcctgcccttgtgaattttcacctgctccttacccctcacctgttaggactgtttcttgcttttgcccctgtcggtcccctgccttaacagacctaagcagctgataatgcaccaagcttccctgaccaggtggggtgtgtctatcacccaagggcagtcctacagaccctgaccaaaggccgttcctgggcggcccaaggtccaggtttcttccacctgctcttccctgtttatggggatttgcaagcctaattgcatcagcaggagcccatctctcagagaacccggactccccaagcagactgggattttgggaagggtgtggggggtgtcattgctggatacccgtctttctgcctgtcctttctcctctctgaatcctggggcccctctccctccttaaagctggagtggacagagggacaggagaggatcagagttcatcccccctgggaaagagcaagagcgaatgaatcccagcgccagcggctgaggctgccttccgtgccttccctccatgggcgacgggtgagtggggcttaggaaactggaacagggaaggttctgttaccacactttggaactttccccctgggattcagcagttgagaagcagagacctttctgccctgggtgaatgggtccttgggggaggggttggtcttttgtctcgcatccccatctttcctttccttctgggccatgctcctccctggctggaaaaaggtggctgtgctgtccctgtgatccactctcagcaaatgcgtgtggctcaaataaacaaagaacttacctgttagagtgaaaatcctcaggagattgtacccaaatgccatgctctaaatattcatggtctctctaatgccctcaagacgtgatttccatgggaaccatcctcccctgggggcagttagcaggagtacgtggggcacgtgaggtggtcctcctttcagcacaccgtgcccatagaaacttctagaaatttctgaaaatgctctgtgggcagctcttgggtggcagtaagtccatcaacccccatctaccccgggcctgaagcgctgcgcttgctctctttatgtgtgtgcacccgaaggatttcctggtctctgtagctgatcctgtgagcccctcaagcatgaagcctcccttggggcttctcaaagcatggagaggggcccttcctgtcctttgggaaaatcttccccactgtgtcagttatatgggaacaagagtgatggggtctttctctaggcctgtgccacaggacagagaacacgggattctgctgttcgctttgagccacagcctttaccagcccggcttgtgtggggggccccttcgccttgctgcaaagagctgttccccaaagggcatatccacagggtacaggttttaaaaaggcttttttttttttttttgagacagggtctcgctctgtcgcctagactcagtgcagtggcgccatgttggctggttgcaacctccacctcctgggttcaagtgattctcccacctcagcctctctggtagctgggactacaggcacgcgccaccatgcccagctaatttttggatttttagtagagaaggagtttcaccatgctgaccaggctggtttcgaactcctgacctcaagtgatccgcccgcctgggcctcccagagtgctgagattacaggcgtgagccaccgcacctggccaaaaaaaggcattttgatttaggttgctgtgtttgcttgttgataaagaaaactcaatcgggacactagttttgtgctcagctttaggccgggtagctaatgggaggatgtccagcctgtcactgtgctcccagcgcaaggaaatgggtgcccacctggaatcaggagaagaggcttttccctcctgttctgcaaccagggtggagctatctttccagggaagccagctgagaggttttagggctttggttattttatgggggttttaaacctcctaacttttcaatgacaaatggctcccaggtgccatagtctctgttaaatcctcaaacattcacaagcacacactgccaggggcacgggttgtctttcacctgcatgtttctaaggctctttattcaatctcacggtgtcagtgtccagttgtcaaagttatgaatcttcctcctgcttctaaacagggctgacagtatactctcgtctagtctaggaacatgtctgctgctgggataccctggtaccaggatttgagggccacgggtggcatctctgagagctgaaaatccacagagtgcctgtgggaaagccaagcccttggctgtgtggcttttctatcccttggatttacaggtctgggaattggctgcttcttagttataaccccagtgacaaatgctggcttaagccacacctgttcccactgttgctagaattcaaacagttgctttttttttttctttttgagaaagggcctcactctgttgcccaggctggagtgcagtggcttgatcacagctcacgaaagcctcaaactcctaggctcaagtgatcctcctgaaaagtaggtaggactacaggcacatgccaccacatacagctaatttgttttcattttttttttttttagagacaggatctcgctgtgttccccaggtaggtcttgaactcctggcctcaagtgatcctcctgccttgacctcccaaagtgctggattacaagcgtgagcccctgcacccggcccaagcagttgcttctttttttctctttttttttttttttgagatggagcctcactctgttgcccaggctggagtgcagtggcgcgatctccactcactgcaagctccgcctcccgggttcatgccattctcctgcctcagcctcccgagtagctgggactacaggcgcctgccaccacacccagctaattttttgtatttttggtacagacagggtttcaccgtgttagccaggatggtcttgatctcctgatctcgtgatccgcccaccccggcctcccaaagtgctggattacaagcgtgagccaccgcgccccgccaagcagttgcttcttatgcaacatgttggttgggacttgtccacgggccaggccaataaaattcttaatcctgcagagagtcagtaccctcatcaccccatcactggaaaacaaatgttttaagctatcaagagagggaatgtgcagcttttggtttctagatgcatggtttggtgtgatctacctttgtgcctaaagggaatgtcccaaacaacagagccttctttgctgtcactccagaattctctacacagaatttcccaagtccattcaggacagacgcgcagtcctctttcaatggaagaagagaggacttttcccctcctgaaaaatgactggagtgtgaacaaggcagctctgtttttctaaataagttgttcttgtgagttttttctggccactgggcatctctgccctcacttttcatccctgccctctaagctgcagaccccatgaccacactgtctgcttccttgagcttcccgcacgaggcttggacctgggggacctggagaccctgcggacagaactgtggctgagccactgtggccaactcttggggagctccacagtgggggttgctggtctgtgaggctgagtctccatttcagagcacacactccctggcagggcgcctctgcctgtgtctcctgcccagcagccgccagcagggaatagttgctggtgtctgagcacaaagagagctttgattacctagagaggaaaaaggctgtcagccagatgcagccaggcccaggggtagatacaggagttgctaaggaaggggccgagccaggagaggccaggcagatccacaaagcccaaggggatgcaggctgggtgtggtttctgagggaacctaccaaatagcaggtagatggaatcagaggactcttgtgtcctgaaagaacctccttaaaaacaactaaaacgaagaacttctggggctgttcacacattgttcaagtcaccccaagatcgttctggcacgctgagctgaacaccaccatctttgttcattctctctctaatgggcaaagcaggatcatcgagttgaaaagttgtaaataatgaggatatttatcccgctatttattttttcaataactgtgacctcctgcactgtgaatgctctgtgacatgagattcttagtttaataaaactgtcattaaatttgaatgaattgatattattggttactgaacactggcatgagtttatttttattgtgaagaaaaaaatctacagcaatctaaactaaacctttctaagaaatctagcagtcagtattgtaatgcaatatatcaaaatctgtacactgtcaataaaataaatgagcacaagt

SEQ ID NO: 183313 - DNA, 4187 bp, Homo sapiens
  Payload ID: 16117
  Gene Symbol: SLC24A4
  Gene Name: solute carrier family 24 (sodium/potassium/calcium exchanger), member 4
  ENST ID: ENST00000525557
  CDS Start-End: 1-1393
agtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctgtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcacctgctccagtgaggttcctgggatccagccccaggaagccttgatcgagggacaaggaggaaggcagtggaaggaaagatagaaggatcagggaggaatgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaacta

SEQ ID NO: 183314 - DNA, 4531 bp, Homo sapiens
  Payload ID: 16117
  Gene Symbol: SLC24A4
  Gene Name: solute carrier family 24 (sodium/potassium/calcium exchanger), member 4
  Uniprot ID: Q8NFF2
  ENST ID: ENST00000531433
  CDS Start-End: 97-1908
agagagaaagttcccggggagagctcgcccctgggagggccgacgtcgagcctgctcgccgcgagggtctcagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctgtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 183315 - DNA, 334 bp, Homo sapiens
  Payload ID: 16117
  Gene Symbol: SLC24A4
  Gene Name: solute carrier family 24 (sodium/potassium/calcium exchanger), member 4
  ENST ID: ENST00000554461
  CDS Start-End: 143-334
aataagtgcctgtgtgttggcaactgcagctaaagctctcctatctctgcaaacatcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatc

SEQ ID NO: 183316 - DNA, 1897 bp, Homo sapiens
  Payload ID: 16118
  Gene Symbol: SLC24A5
  Gene Name: solute carrier family 24 (sodium/potassium/calcium exchanger), member 5
  Uniprot ID: Q71RS6
  ENST ID: ENST00000341459
  CDS Start-End: 74-1576
cctcacatgatccagtttaatcctcctcttctcccttcctgaagctgcacgctgcagtaagagcacagcagaaatgcagacaaaagggggccaaacatgggcgagaagggctctgttgctcggcatcctgtgggccactgcacatctgcctctctcagggacctccctgccccaacgtctcccaagggccacaggaaatagcacccaatgtgttatttctccatcatcggagtttcccgaagggtttttcacgagacaggagcgcagagatggaggcatcataatctatttcctaattatcgtttacatgttcatggccatatctattgtctgtgatgaatacttcctaccctccctggaaatcatcagtgaatcccttggattgtctcaggatgttgcaggcacaactttcatggcagcgggcagttcagctcctgaattagttactgctttcctaggtgtatttatcacaaagggagatattggcattagcaccatccttggatctgcaatttataatctccttggcatctgtgctgcctgtggtttgctatctaatacggtctcaacactatcatgttggcccctattcagagactgtgcagcgtacacaattagtgcagcagcagttcttggtataatatatgacaaccaagtttactggtatgaaggggctttactgcttttgatatatggattgtatgttttggtgctgtgttttgacattaaaattaaccaatatattataaagaaatgcagtccttgctgcgcctgtcttgccaaagctatggagagaagtgaacaacagccactgatgggctgggaagatgaaggtcaaccattcattcgtcggcaatcaagaactgatagtggaatattttatgaagattctggctactctcagctctctataagtttacatggccttagtcaggtttctgaagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggggcagagagaaaaatccatttcttcatttaaatcaaattttaaaaatcttgaaccttagaatctaaaacttacagtaatttaaaaccaaccaaaatcacatcctaatttttctgagccctttcttttcatgaaaaattacatattataaaacagaagtttggggggaaaaaatctatgttttaccatacaataagttgacaaaaactggagaaactagaacaaacaaatccaactatgtagtactgaaaacaacaagaaaatggcttatttcattaaa

SEQ ID NO: 183317 - DNA, 1388 bp, Homo sapiens
  Payload ID: 16118
  Gene Symbol: SLC24A5
  Gene Name: solute carrier family 24 (sodium/potassium/calcium exchanger), member 5
  Uniprot ID: Q71RS6
  ENST ID: ENST00000449382
  CDS Start-End: 22-1344
tgcagtaagagcacagcagaaatgcagacaaaagggggccaaacatgggcgagaagggctctgttgctcggcatcctgtgggccactgcacatctgcctctctcagggacctccctgccccaacgtctcccaagggccacagcccttggattgtctcaggatgttgcaggcacaactttcatggcagcgggcagttcagctcctgaattagttactgctttcctaggtgtatttatcacaaagggagatattggcattagcaccatccttggatctgcaatttataatctccttggcatctgtgctgcctgtggtttgctatctaatacggtctcaacactatcatgttggcccctattcagagactgtgcagcgtacacaattagtgcagcagcagttcttggtataatatatgacaaccaagtttactggtatgaaggggctttactgcttttgatatatggattgtatgttttggtgctgtgttttgacattaaaattaaccaatatattataaagaaatgcagtccttgctgcgcctgtcttgccaaagctatggagagaagtgaacaacagccactgatgggctgggaagatgaaggtcaaccattcattcgtcggcaatcaagaactgatagtggaatattttatgaagattctggctactctcagctctctataagtttacatggccttagtcaggtttctgaagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggg

SEQ ID NO: 183318 - DNA, 2984 bp, Homo sapiens
  Payload ID: 16118
  Gene Symbol: SLC24A5
  Gene Name: solute carrier family 24 (sodium/potassium/calcium exchanger), member 5
  ENST ID: ENST00000482911
  CDS Start-End: 42-410
cccttcctgaagctgcacgctgcagtaagagcacagcagaaatgcagacaaaagggggccaaacatgggcgagaagggctctgttgctcggcatcctgtgggccactgcacatctgcctctctcagggacctccctgccccaacgtctcccaagggccacaggaaatagcacccaatgtgttatttctccatcatcggagtttcccgaagggtttttcacgagacaggagcgcagagatggaggcatcataatctatttcctaattatcgtttacatgttcatggccatatctattgtctgtgatgaatacttcctaccctccctggaaatcatcagtgaatgtaagtggctggaaagttgccctgtaaccttctgggagagtgtgccacacagatatgactgtctttgaaatagctcagcagctgtcctgtacttctcaactggttgcagagcaccagcttcttgttgtggggtcccgtgtcttaaggaactggtcgagtgtggtttctcttggtagttaatgtgaatcagagtttcttcaagttagaacccggcagttattatttttctgcctatttccagaaatctctagtttgtctactgcctggatgtttgttataagaactgttccaagatttcacttgtatgtactttgtgtgcgctcctaatacaatgaaactcctaatatttgccattttatgcttcaaaaaacttttttttatttttactctaagctcgctataactttgattataaaaagtgataaacaaatgcaattaaggaccaccctccccatcttcctttcccagcatcctaccattaaggaaattaattgatatttaagaaccaataaacagatagatgaataagtcctgtatcctaagtgaccttagacatcagatgactgtaaaatcagttattaaaaattaagagctccatttattggtttctgaaaataagatcagccggtccaagcctctgagctctgttccttcagcagtatatgttgcccagaattctgagcatagaccttcactggtgcactggtccctaaacaccaggatagcagttatgttctgtgccatatgagcaaaagtgtgtttctagacttggtctcatgtttggttatttatttggctgagcatgcccacattacagcaaaaagcaatgtcaaaattaaggattgggtttcctattgcatattcacaagactgcacagtaacagcagcgtcctcaacctccacccaccgcccccgacacacacacattgctgccatttctttataaagggaaagagcatgaatgtaaactctcccttttcccatcaccccacccccaacccctgctgaaatgcaaagcgaattatttcctcccttgttcactgcagtataccagaatctgtaggctctaaaacagtaactggtgatagcagaggcactcaacacctatctgtttaatgaaaatatataatatatatatatatgatagattagcctaatttattacaatttttcttaagtagatacaaacatatgcttttatcttgacgttacatcttatatataattgatattttctttaataaagattaaattatttaacagttttacttagattaatgaaatacaagaaaaatagaagagaaagataaaatcacctgtatttccatctacacagttaccatttggtatatttcctttaaatcttttgaatcttgctttatatacagtttgggatctttcctttttttcacacaatattttatagtgcacattttccaatattattaaacattcttcaaaaacattatttttaatgatatcatgatagtccatgattctataaatgatttgagcgtctgacactggtttttacacatagtaggcacccagtagaaatttatcataaaatttaaaactattactctcattggacatttggcctgttttaagttttttgtgttaatgtcatgcccataattgtataaaatctttgcacacctctctgatcatttcctgattaagaggcagagatgtggatattttaagtcttatgatatatatttgcaaaaggcatcccacaaaaggtgtgcctacttatacctccttaagcatccattccagaaaaccatgaaaaatatgtgaaatatccttggttgctttaacctcccattattttataaaatttgtgtttatcttattatccatgagggtgaatattttatatgtttattttattttatggttttccttttgtgtttttttgcccatattatatcaggggtattctgtctctttcttattgattttcaagactttaaaaatatataaggatattaaccctttttctagtattacttcatatcatatgctttttcatggtttgtttgattttgcattttgtgtttatcacattgaagtttgaagtttaaatattttaagtaaatttgtaaatctttttctttatggttctccttttggttttataactagaaaggcatttttatccataggtcacaacaatcatcatattttattctacatgcaggattttttaaaatttatttattttttccactaagaatctgtcttgctataggatgtaatgttcttttttccaacagttgatcaattttcatatactaagttcttatatagatgtagatctgtctctatgctcccaactctgttctaataacctttttgtacattcttatgccaatactgcacttttaattagaaaaatgtaaaaaactaaaaattgaaaaattaaaaatgttaatcatataaaacacagaaatttaaattgtaaggaataatttccatttctaatgacttaactgaacaatgacatgactgaaaaaataaatctatcaagaattttattataaaaattatcttaggagaagtgaaaaataaataaaaaacctttctagccctgtagaagacactactgcattaaaatttagattatgacttcaaaa

SEQ ID NO: 183319 - DNA, 2429 bp, Homo sapiens
  Payload ID: 16119
  Gene Symbol: SLC25A12
  Gene Name: solute carrier family 25 (aspartate/glutamate carrier), member 12
  ENST ID: ENST00000263812
  CDS Start-End: 10-273
gagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatggaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtattt

SEQ ID NO: 183320 - DNA, 2979 bp, Homo sapiens
  Payload ID: 16119
  Gene Symbol: SLC25A12
  Gene Name: solute carrier family 25 (aspartate/glutamate carrier), member 12
  Uniprot ID: O75746
  ENST ID: ENST00000422440
  CDS Start-End: 39-2075
gctcgctcactcgctcgtccccggcttccgagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgta

SEQ ID NO: 183321 - DNA, 911 bp, Homo sapiens
  Payload ID: 16119
  Gene Symbol: SLC25A12
  Gene Name: solute carrier family 25 (aspartate/glutamate carrier), member 12
  ENST ID: ENST00000426896
  CDS Start-End: 31-663
actcgctcgtccccggcttccgagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttggaggagttctctggccacaccgttggtacagcagctccttccaggctcattcatggaacaggcatggtggcagtcttggagaagagtgccagccccggtcagagaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgc

SEQ ID NO: 183322 - DNA, 829 bp, Homo sapiens
  Payload ID: 16119
  Gene Symbol: SLC25A12
  Gene Name: solute carrier family 25 (aspartate/glutamate carrier), member 12
  ENST ID: ENST00000475360
  CDS Start-End: 1-528
gtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttggattttggatctggggtaaaggaggagttctctggccacaccgttggtacagcagctccttccaggctcattcatggaacaggcatggtggcagtcttggagaagagtgccagccccggtcagagggaagaaatgaatcctgcattccatttcaaagaaaagatgagaatcccatctccccagtgacatccaatgccttcttccaactttgctgattgctgcaatctattcagagctattatattgactctagactgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttac

SEQ ID NO: 183323 - DNA, 3136 bp, Homo sapiens
  Payload ID: 16120
  Gene Symbol: SLC25A13
  Gene Name: solute carrier family 25 (aspartate/glutamate carrier), member 13
  Uniprot ID: Q9UJS0
  ENST ID: ENST00000265631
  CDS Start-End: 138-2165
ggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 183324 - DNA, 3192 bp, Homo sapiens
  Payload ID: 16120
  Gene Symbol: SLC25A13
  Gene Name: solute carrier family 25 (aspartate/glutamate carrier), member 13
  Uniprot ID: Q9UJS0
  ENST ID: ENST00000416240
  CDS Start-End: 192-2222
aatgggcgggcagcatccacatgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtg

SEQ ID NO: 183325 - DNA, 568 bp, Homo sapiens
  Payload ID: 16120
  Gene Symbol: SLC25A13
  Gene Name: solute carrier family 25 (aspartate/glutamate carrier), member 13
  ENST ID: ENST00000472162
  CDS Start-End: 181-402
agcatccacatgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtg

SEQ ID NO: 183326 - DNA, 1879 bp, Homo sapiens
  Payload ID: 16121
  Gene Symbol: SLC25A20
  Gene Name: solute carrier family 25 (carnitine/acylcarnitine translocase), member 20
  Uniprot ID: O43772
  ENST ID: ENST00000319017
  CDS Start-End: 200-1105
atcgaagcggggccgaggccggaagcagccccgggcggaagccctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtt

SEQ ID NO: 183327 - DNA, 1383 bp, Homo sapiens
  Payload ID: 16121
  Gene Symbol: SLC25A20
  Gene Name: solute carrier family 25 (carnitine/acylcarnitine translocase), member 20
  ENST ID: ENST00000440964
  CDS Start-End: 99-329
aaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggggaggttatgcctgactatgggagatctgaaggacaatatgagggattttggatgtaaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccac

SEQ ID NO: 183328 - DNA, 1576 bp, Homo sapiens
  Payload ID: 16121
  Gene Symbol: SLC25A20
  Gene Name: solute carrier family 25 (carnitine/acylcarnitine translocase), member 20
  ENST ID: ENST00000430379
  CDS Start-End: 111-797
ccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtttctaa

SEQ ID NO: 183329 - DNA, 2244 bp, Homo sapiens
  Payload ID: 16122
  Gene Symbol: SLC25A18
  Gene Name: solute carrier family 25 (glutamate carrier), member 18
  Uniprot ID: Q9H1K4
  ENST ID: ENST00000327451
  CDS Start-End: 539-1486
gagactcctgcaggttcgagaaagcatgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcag

SEQ ID NO: 183330 - DNA, 2057 bp, Homo sapiens
  Payload ID: 16122
  Gene Symbol: SLC25A18
  Gene Name: solute carrier family 25 (glutamate carrier), member 18
  Uniprot ID: Q9H1K4
  ENST ID: ENST00000399813
  CDS Start-End: 465-1412
aggttcgagaaagcatgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcagggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggct

SEQ ID NO: 183331 - DNA, 2385 bp, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENST ID: ENST00000359232
  CDS Start-End: 302-1213
cactcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaagtggc

SEQ ID NO: 183332 - DNA, 2242 bp, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENST ID: ENST00000392908
  CDS Start-End: 210-647
gagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgtttttt

SEQ ID NO: 183333 - DNA, 5169 bp, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENST ID: ENST00000554912
  CDS Start-End: 3289-4002
ctgccacccaggagaaacagaacatggccagccctctggaagtcttccctcctgctcctatcaactcctccctccccttctgaggcttccactggcctaacttcctcctttttttttgagacacggtcttgctctgtcaccctaggtggagtgcagtggtgcaatcatagcccactgcagccttgatttcccaggctcaagcaatcctcccaccgcagcctctcaagtagctgaaactacaggcacacaccaccatgcctagctcatgttttttttgaagttattagtagagatggggtcttgatatgttgcccagctggtctcaaactactgggctcaagtgatcctcctgccttggcctcccaaagtgctgggatgacaggcctggcccactgtcctcacttccaacaccacgggtcccttttgcctggttgaatataattgcagctgtaccctaggatcatcaggggccacccgagtctgtgtcagtccgtactgtcacatggccacagactatctcatggctgggacagtcacagtttattcccccaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggctgtctccatccatagcaaaagtgtaactttgttgtagatgggcgtaagcctcaccctggagagcgctagtaagtacagaccaggtgaaccagatcccagcctggaccccaccctgtcatgcccatctccccaaccccagagttccctccgtagcaggggacagggagggtgtgaggcaagcttgggctcagcacaggtcctggggtgggggctcgggctggccaaaaaaaatcagccccctctggattgggggtcctcatgtgggggtctctcggccctatggggagctgggagcttcctaaacttgtgtccaaatgactagtttcccaggggtgggtccgttcccatcaatcctcaaaggagagcctggcaccccaagattttaagagcctgagctataaatgacaagacttgggacactgggccacagttcctctcccagagagcaagggctcgtcacagactgaggggtactgaggggtcagaaacaaagtggggagaggcctctgcccacattggtgggagaagctgagttgacctaagcctgacattccccagccggctggacttgggcattcaccagtgtctgtgatctgcaaagacttcacaacactacccaggtggcactgagtatccaacctgggaagggacagctccatgtcacatcagttctactcacacagccctcttagtgccagtgttggggctgcaggaggaacagagatccccccagaggccccagaacattgaagggagagcagcaaacctcgcatcaaggtgttggccaagaactgggcctccagggtgggagggtgcttcgggccaatcttgaagcattggcttccagctgttgaggtcctgggggtactgagatggtacttgtttcctaacaaaacattttttataagtgcattcaccaatagagggcccacctattctggtggagagaattggaaaaggttccagaatccgggcagaagcctggctgttcccggtgagggctctcccttgctagcactccctcccaccctcactctgagcaacacagctgctcatgtccctggagaggacagctttggccaagttgttaaacatctctgagcctgtcttcccatcttggaaatgggggcagttgtcccaatgccgagataattgagtgtgaagccctcccctgtcccatgctgcctagtaccgaaggcacttgctctgtggccctggctgtaagaatgatcatttctgagtcagacctagggaaccagcccctgagaatgtgacttgacctagtttactcccaccgcccgctctgcaactctgagcctcctattgagcaaagataagctcataggcaacaaagagcactttgacatggaagaggttctgggccactgggctcggaggcagcggggcctgaccagcgccccaggccccagagctgctgacgtgggtccccaaggaggttgttggctgttctcttgccaccactctattaactcataactgctgttctcacgagaggctactggcagagaccaggcaggagctcctggagccaaggtcattgcttttatttttatttatttatttattgagatggaatgttcctttctcgcccaggctggagtgcagtggcatgacctcactgcatcctctgcctcacgggttcaagcaattctcccacctcagcctcctgagtagcagggattacaggcgtatgccaccacactaggctaattttttttacagacacgatttcgccacgttggccaggctggtcttgaactcctgacctcaagtgatccacccacctcagcctcccaaagtgttgggattacaggcgtgagccactgcacctggccaggctcatcactttttgcgcctattgcctcgaagccagtctctgatgggacattagggcaggggcccttcagcctagtctgggacatgggccgctcactcagcagtatgacaagcatcacctggagaacgggccagtctcaggaggtcgttcatgccccactggcagtgcactgtgcagccatagtgtaaacaagaggcttaacctgaattggtctgagatcttggggaccccctaccctgtctccagcagcctgtccctttagctgtttgcctactggcaccccatcctgagaaggcatagatacccggcccaccctgccctggaattacaaaagtcttagactgtgcctgagtgcccggcctccttgggagaccctcctaggcagcctaagcaccagacccgggagctgggtgctctggtcctgcctgcctgcctctcactggaccctctccttccaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 183334 - DNA, 1124 bp, Homo sapiens
  Payload ID: 16123
  Gene Symbol: SLC25A29
  Gene Name: solute carrier family 25 (mitochondrial carnitine/acylcarnitine carrier), member 29
  ENST ID: ENST00000554224
  CDS Start-End: 316-423
ccgcccattggcctcactcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgt

SEQ ID NO: 183335 - DNA, 674 bp, Homo sapiens
  Payload ID: 16123
  Gene Symbol: SLC25A29
  Gene Name: solute carrier family 25 (mitochondrial carnitine/acylcarnitine carrier), member 29
  ENST ID: ENST00000554060
  CDS Start-End: 259-674
cggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggca

SEQ ID NO: 183336 - DNA, 1067 bp, Homo sapiens
  Payload ID: 16123
  Gene Symbol: SLC25A29
  Gene Name: solute carrier family 25 (mitochondrial carnitine/acylcarnitine carrier), member 29
  ENST ID: ENST00000556868
  CDS Start-End: 286-654
ccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctc

SEQ ID NO: 183337 - DNA, 1025 bp, Homo sapiens
  Payload ID: 16123
  Gene Symbol: SLC25A29
  Gene Name: solute carrier family 25 (mitochondrial carnitine/acylcarnitine carrier), member 29
  ENST ID: ENST00000556715
  CDS Start-End: 284-391
gggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggg

SEQ ID NO: 183338 - DNA, 960 bp, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENST ID: ENST00000555927
  CDS Start-End: 194-907
agcaataatcagggagcagttgtcttgacctatgatgaggggatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataa

SEQ ID NO: 183339 - DNA, 569 bp, Homo sapiens
  Payload ID: 16123
  Gene Symbol: SLC25A29
  Gene Name: solute carrier family 25 (mitochondrial carnitine/acylcarnitine carrier), member 29
  ENST ID: ENST00000554291
  CDS Start-End: 181-569
taactgctgttctcacgagaggctactggcagagaccaggcaggagctcctggagccaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcggg

SEQ ID NO: 183340 - DNA, 1540 bp, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENST ID: ENST00000556505
  CDS Start-End: 230-943
tttgtgttgctttaaccgcctttactttctgagctaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaact

SEQ ID NO: 183341 - DNA, 1121 bp, Homo sapiens
  Payload ID: 16124
  Gene Symbol: SLC25A16
  Gene Name: solute carrier family 25 (mitochondrial carrier), member 16
  ENST ID: ENST00000493963
  CDS Start-End: 64-237
ctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttt

SEQ ID NO: 183342 - DNA, 538 bp, Homo sapiens
  Payload ID: 16124
  Gene Symbol: SLC25A16
  Gene Name: solute carrier family 25 (mitochondrial carrier), member 16
  ENST ID: ENST00000491102
  CDS Start-End: 42-320
gtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggagaagaagaggagtttacttcaaacagaacctggcaatcggataaataccttcaagtgtctgtctccgtaaaaatgttccagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccc

SEQ ID NO: 183343 - DNA, 311 bp, Homo sapiens
  Payload ID: 16124
  Gene Symbol: SLC25A16
  Gene Name: solute carrier family 25 (mitochondrial carrier), member 16
  ENST ID: ENST00000474927
  CDS Start-End: 1-198
gcatttgagcattataaaacgttaattactacgaagctgggaatttcaggtcatgtgcacagattaatggctggatccatggcaggtaaacatattctactatttgtattggattgtagttgtaaactgagggaagaagaaagctgttaccaccactattcaaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttaca

SEQ ID NO: 183344 - DNA, 6529 bp, Homo sapiens
  Payload ID: 16124
  Gene Symbol: SLC25A16
  Gene Name: solute carrier family 25 (mitochondrial carrier), member 16
  Uniprot ID: P16260
  ENST ID: ENST00000609923
  CDS Start-End: 100-1098
gcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaggtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgactttttttttttttttgagatggagtctcgctctatcgcccaggctggagtgcagtggcgcgatctcagctcactgcaacctctgcctcccgggttcaagtgattctcctgcctcagtctcccgagtagctgggactacaggtgcccaccaccaaaaattcgcctggctaatttttgtatttttagtagagacgggatttcaccgtgttagccaggatggcctcgatctcctgaacctcatgatctgcccaccttggtctcccaaagtgctgagattactggcgtgagccacggcgcccggccctttgatgtgactttaaagacattagaaggccaggtgtggtggctcacgcctttattcccagcactttgggaggccgagttgggtggatcacctgaagtcaggagtttaagatcagcatggtgaaaccccacctctactaaaaatacaaaaagtagcaggtgtggtggctcgtgcctgtagtcccagttactcgcgaggctgagacatgagaattgcttgagctcgggaagcggaggttgcagtgagctgagatcacaccactgcactccagcctgggtgacagaatgagcctccatctcaaaaaaaaggagacattagaaaactaagttgagtccaggcgtggtggctcttgcctgtaaccctagcactttgggaggctgaggcgggaggatatcttgaccccaggagttcgagaccagcctgggcaacatagtgagaccccgtttctttcaaacaaaagaaggaaaactaagttgaaagtgttatttttgcttcaatttttatttctttacataaaaggtttcttgtcataccttggtaaaaatttgatgagctggtttcattttgaaagcctttattttaaaaataagtatgtatctttgtatgatttataagtgtaccagtaggtagaaatacatgtgttcttggccagatgtggtggctcacgcctgtaatcccagcattttgggaggctaaggcgagtggatcacctgaggtcaggagttcaagaccagactggccaacgtggagaaaccctgtctctactaaaaatacaaaaatcagccgggcatggtggcgggcgcctgtaatcccagctacttgggaggctaaggcagggagaattgcttgaacccaggaggcacaggttgcagtgagccaagattgcgccattgcactccagcctgggtggctgtataaaagcctgtataaaaatttcttttatacagagtgagactgtataaaagaaaaaaaaaggctgtacaaaaatttcttttatacagagactgtataaaagaaaaaaaaaagaaatacatgtgttcttaaaaccatttgtatattttcatttctagaccacactgtagctaattattgttattaaatgttaagataatttaagtatataaaataagtattgagccgggcatggtggctcacccctgtaatctcagcactttgggaggctgaggcggggggatcacgaggtcaggaaatcgagaccattgtggctaacacggtgaaaacctatctctactaaaaatacaaaaaattagctgggcgtggtggcacgcacctgtagtcccagttactcaggaggctgagacaggagaatcacttgaacctgggaggcggagcttgcagtgagccgagatcgtgccactgcattctaacctgggcgacagagcaagactccatctcaaaaaaaaaaaaaaaaaaaaaaaagatacctcagttaggttatcagtaaaaggggattgcaaatatcttttaaataaaaatttgcattctatatgttatagaatacagaggatattaaaaataaattttatccatgttttgacaatttctttctttcaactgtttacatattgaagcacaaatgctaaacataagtcagaatggaagaatatttaaaataatgactgtgtttatatctgatttatttcagattgcccaaagtgcatcttgccaggttatcttccatttgaagactgacattttatttcttttttgatctttattgttcctctcttccacctctcagtgggtatagctctctggtctgtagaatgggacagtggtctggtttccagattgataagtgaggtatacctcctagttttcagtaattacctgtagaaggtggagaagttactggatatgtttaataatatctcattacattcttttttttttttttttaacgagagtcttaactctgtcacccaagctggagtgcagtggtgcaatctcggctcactgcaatctccacctccgggttcaagcgattttcccgagtcatctttccaagtaactgggattacagctatgtgctaccatgcccagctgagttttgtatttttctttcttttctttcttttttttttttttttttgagacagagcctcactctgttgcccaggctggagtgcccaggctggagtgcagtggtgtgatctcagctcactgcaacctccacctcctgggttctagcgattctcctgcttcagcctcccgagtagctggggttacaagcacccgccaccacgcccagctaatttttgtgtatttagtagagctgggttttgccctgttggccaggctggtcttgaatacctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcagggagcacagggtatggcgtcagagtggtactcagtgatgtttactggtgggtagaaggaagggttagtccctgtttttgaagactttatgttctagcaggcagaaatgaagcacaaatagttcaagaaataaacaatttaggaataaagtcatttggtttgcttcgcagaaatgtcttattgctgatttgccagcatgagtggcaaatatataataaaacctggccgggcatggtggctcacgcctgtaatcccagcactttgggaggccaaggtgggcggatcacgtggtcaggagatcaagaccatcctggccaacatggtgaaatcccatctctactaaaaatataaaaattagccaggcatggtggtgggcgcctgtagtcccagctacttgggaggctgaggtaggagaattgcttgaacccagaaggcggaggttgcagtgagccaagattgccccactgcactccagcctgggtgacagagtgagactctgtcccaaaaaataaaaataaaaataaatgaatatataaaataaaaaatatatgtatacatatcatatatatatataaaataaaacttataaatagtttttatggctgggtgaagtgactcatgtctgtaattctagccctttgggaggctgagcgaggaggatcacttgagcctaggcattcgagcccagcctgggcaacattgcaagactctgtctcatttttttatataaaatgtttttttaaaaaaccctatgtataattatttattttttttccccaaggattattcccaaactatgtacaattaatgggttgccttgcagagttggatcaataatacctgacacacttgtatagcaagcatacactttacatagttcctcgcatctattctttgaaacccagacacattctagtattgggcactagaaactggtgataaataataacaattacatatatttcctgaagaattatgtggcattccttgttttaagcacctttgatgccttagctcaatctccattacaatactatgatataagtaccatttaatatttctttttgacagatgggaataatcgaggcctagggagattaaattacttggccaggttcatgtaagtggcagatctaggattcaaattcagccggtctgaatctagagcctattcttttagctatgatgctatactttaatacagtaatacactgttcaaatgaaactgtaacatgtcattaaatttgaacttgtcaataaacataccaagcaataaaa

SEQ ID NO: 183345 - DNA, 263 bp, Homo sapiens
  Payload ID: 16124
  Gene Symbol: SLC25A16
  Gene Name: solute carrier family 25 (mitochondrial carrier), member 16
  ENST ID: ENST00000608053
  CDS Start-End: 1-197
ggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgcctgtaagttcatcatatgtcattgttcattttctttaggaaatgtaacattaaactcagtaaggagatagga

SEQ ID NO: 183346 - DNA, 1616 bp, Homo sapiens
  Payload ID: 16125
  Gene Symbol: SLC25A14
  Gene Name: solute carrier family 25 (mitochondrial carrier, brain), member 14
  Uniprot ID: O95258
  ENST ID: ENST00000218197
  CDS Start-End: 228-1205
ctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcac

SEQ ID NO: 183347 - DNA, 1062 bp, Homo sapiens
  Payload ID: 16125
  Gene Symbol: SLC25A14
  Gene Name: solute carrier family 25 (mitochondrial carrier, brain), member 14
  Uniprot ID: O95258
  ENST ID: ENST00000339231
  CDS Start-End: 1-1062
atgggtatctttcccggaataatcctaatttttctaagggtgaagtttgcaacggcggccgtgattcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggtgcttatgttcaaaagctgttaccggctgtgtgctgtggctcatgcctgtaatcccagcactttgggaggccaacgcgggtggatcacttgagggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaa

SEQ ID NO: 183348 - DNA, 969 bp, Homo sapiens
  Payload ID: 16125
  Gene Symbol: SLC25A14
  Gene Name: solute carrier family 25 (mitochondrial carrier, brain), member 14
  Uniprot ID: O95258
  ENST ID: ENST00000361980
  CDS Start-End: 1-969
atgggtatctttcccggaataatcctaatttttctaagggtgaagtttgcaacggcggccgtgattcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaa

SEQ ID NO: 183349 - DNA, 831 bp, Homo sapiens
  Payload ID: 16125
  Gene Symbol: SLC25A14
  Gene Name: solute carrier family 25 (mitochondrial carrier, brain), member 14
  ENST ID: ENST00000424447
  CDS Start-End: 237-831
cgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggg

SEQ ID NO: 183350 - DNA, 1650 bp, Homo sapiens
  Payload ID: 16125
  Gene Symbol: SLC25A14
  Gene Name: solute carrier family 25 (mitochondrial carrier, brain), member 14
  Uniprot ID: O95258
  ENST ID: ENST00000545805
  CDS Start-End: 262-1239
gttggtttcaatgcttccgggttggcgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcac

SEQ ID NO: 183351 - DNA, 1403 bp, Homo sapiens
  Payload ID: 16125
  Gene Symbol: SLC25A14
  Gene Name: solute carrier family 25 (mitochondrial carrier, brain), member 14
  ENST ID: ENST00000543953
  CDS Start-End: 120-992
gttggtttcaatgcttccgggttggcgctgcagtggcgtttccgactgtgggagcctcagcttcccagtcgtccgatgagcccgagcagcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcac

SEQ ID NO: 183352 - DNA, 1734 bp, Homo sapiens
  Payload ID: 16125
  Gene Symbol: SLC25A14
  Gene Name: solute carrier family 25 (mitochondrial carrier, brain), member 14
  Uniprot ID: O95258
  ENST ID: ENST00000612248
  CDS Start-End: 262-1323
gttggtttcaatgcttccgggttggcgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggtgcttatgttcaaaagctgttaccggctgtgtgctgtggctcatgcctgtaatcccagcactttgggaggccaacgcgggtggatcacttgagggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcac

SEQ ID NO: 183353 - DNA, 2796 bp, Homo sapiens
  Payload ID: 16126
  Gene Symbol: SLC25A22
  Gene Name: solute carrier family 25 (mitochondrial carrier: glutamate), member 22
  Uniprot ID: Q9H936
  ENST ID: ENST00000320230
  CDS Start-End: 385-1356
cccccggcagcttccccttctgtgtgagtgctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtaga

SEQ ID NO: 183354 - DNA, 606 bp, Homo sapiens
  Payload ID: 16126
  Gene Symbol: SLC25A22
  Gene Name: solute carrier family 25 (mitochondrial carrier: glutamate), member 22
  ENST ID: ENST00000456706
  CDS Start-End: 263-606
gtgcacgtgagccccgagcgtgagcggcgtgtgaggctggctgggaagacgctggcggtggggagggggggactgaaaggaagccaggtggtcccaggggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcac

SEQ ID NO: 183355 - DNA, 839 bp, Homo sapiens
  Payload ID: 16126
  Gene Symbol: SLC25A22
  Gene Name: solute carrier family 25 (mitochondrial carrier: glutamate), member 22
  ENST ID: ENST00000532484
  CDS Start-End: 270-839
gcacatacgtgtccccgagggtgggtgtccggggcccgagcccaaggaagaaaggccgacccgtgtgggacgcacacgtgggagttcaccggacatctgtggacacgacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactc

SEQ ID NO: 183356 - DNA, 1108 bp, Homo sapiens
  Payload ID: 16126
  Gene Symbol: SLC25A22
  Gene Name: solute carrier family 25 (mitochondrial carrier: glutamate), member 22
  ENST ID: ENST00000481290
  CDS Start-End: 170-1108
ttctaggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatccctagacagtccagggaccctggcctccggctggccccagctggccctggctcaccctgtccccttggccacaggtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcc

SEQ ID NO: 183357 - DNA, 1079 bp, Homo sapiens
  Payload ID: 16126
  Gene Symbol: SLC25A22
  Gene Name: solute carrier family 25 (mitochondrial carrier: glutamate), member 22
  ENST ID: ENST00000529351
  CDS Start-End: 551-769
cgcacatacgtgtccccgagggtgggtgtccggggcccgagcccaaggaagaaaggccgacccgtgtgggacgcacacgtgggagttcaccggacatctgtggacacgtgcgtggccggagtcgcggtggccaggcggaggacggagcggtcggctgagccccagcagtagggcaggggcctgagccggcctccgagcgcagagagcggcccccaacccgcttctcctttgtcctctggccgaggcatcgcgcagttggagtccccttccgggaccctccagccagcaggatagaaagcaccgccccaagaggacggggacagcgggagattgaatggggagccgccggccagactcggagcctcacccccattgcctttcttgggggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggtgaggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccg

SEQ ID NO: 183358 - DNA, 569 bp, Homo sapiens
  Payload ID: 16126
  Gene Symbol: SLC25A22
  Gene Name: solute carrier family 25 (mitochondrial carrier: glutamate), member 22
  ENST ID: ENST00000528936
  CDS Start-End: 260-569
gtgagtgcctggggcagagtgagagcaggaccagcgggcaggtggcggagcgggggtcggtggtggatggcccagccctggaaagccgaggtgaaggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgc

SEQ ID NO: 183359 - DNA, 558 bp, Homo sapiens
  Payload ID: 16126
  Gene Symbol: SLC25A22
  Gene Name: solute carrier family 25 (mitochondrial carrier: glutamate), member 22
  ENST ID: ENST00000529066
  CDS Start-End: 324-558
atgggaggagagctatacctgggatagctgagcccaggtcggggggtcttagggcgcccgggaccccagcccctagctcgaagggggcaggtgccggctgctgctctctctgtgctgaaggatgtgggggatggtcaccacagctgtccaggtcgaggtgctccgaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccg

SEQ ID NO: 183360 - DNA, 583 bp, Homo sapiens
  Payload ID: 16126
  Gene Symbol: SLC25A22
  Gene Name: solute carrier family 25 (mitochondrial carrier: glutamate), member 22
  ENST ID: ENST00000527734
  CDS Start-End: 219-437
gaagacgctggcggtggggagggggggactgaaaggaagccaggtggtcccaggggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggtgaggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtg

SEQ ID NO: 183361 - DNA, 641 bp, Homo sapiens
  Payload ID: 16126
  Gene Symbol: SLC25A22
  Gene Name: solute carrier family 25 (mitochondrial carrier: glutamate), member 22
  ENST ID: ENST00000531514
  CDS Start-End: 218-436
ggtgctggccgagcgcggggcgggcaggcgagcgcggcggcggcggcgagcgtggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggtgaggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgccca

SEQ ID NO: 183362 - DNA, 746 bp, Homo sapiens
  Payload ID: 16126
  Gene Symbol: SLC25A22
  Gene Name: solute carrier family 25 (mitochondrial carrier: glutamate), member 22
  ENST ID: ENST00000533385
  CDS Start-End: 263-746
gtgagagcaggaccagcgggcaggtggcggagcgggggtcggtggtggatggcccagccctggaaagccgaggtgaaggttacgagtccctgaggatctgacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggagg

SEQ ID NO: 183363 - DNA, 666 bp, Homo sapiens
  Payload ID: 16126
  Gene Symbol: SLC25A22
  Gene Name: solute carrier family 25 (mitochondrial carrier: glutamate), member 22
  ENST ID: ENST00000527723
  CDS Start-End: 264-666
aaaggaagccaggtggtcccaggggtgagcatgggactgggtggcaggtgcctcccgctgctgcaccctcaggacgcagtgacggcttcagtctggggtggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcag

SEQ ID NO: 183364 - DNA, 736 bp, Homo sapiens
  Payload ID: 16126
  Gene Symbol: SLC25A22
  Gene Name: solute carrier family 25 (mitochondrial carrier: glutamate), member 22
  ENST ID: ENST00000530360
  CDS Start-End: 540-736
gctggccgagcgcggggcgggcaggcgagcgcggcggcggcggcgagcgtggctgccggaagcctctgcttgcccaaagtgaaagagaaagtgcccccccacccaagcccgccccaccccgccccacggccaatccctgcggcccctcgcctcctcccccggcagcttccccttctgtgtgagtgctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgta

SEQ ID NO: 183365 - DNA, 824 bp, Homo sapiens
  Payload ID: 16126
  Gene Symbol: SLC25A22
  Gene Name: solute carrier family 25 (mitochondrial carrier: glutamate), member 22
  ENST ID: ENST00000531534
  CDS Start-End: 357-824
agctctgcaggccctaggtggagctgccatgggaggagagctatacctgggatagctgagcccaggtcggggggtcttagggcgcccgggaccccagcccctagctcgaagggggcaggtgccggctgctgctctctctgtgctgaaggatgtgggggatggtcaccacagctgtccaggtcgaggtgctccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcc

SEQ ID NO: 183366 - DNA, 802 bp, Homo sapiens
  Payload ID: 16126
  Gene Symbol: SLC25A22
  Gene Name: solute carrier family 25 (mitochondrial carrier: glutamate), member 22
  ENST ID: ENST00000531437
  CDS Start-End: 214-802
aggtgctggccgagcgcggggcgggcaggcgagcgcggcggcggcggcgagcgtgaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttct

SEQ ID NO: 183367 - DNA, 565 bp, Homo sapiens
  Payload ID: 16126
  Gene Symbol: SLC25A22
  Gene Name: solute carrier family 25 (mitochondrial carrier: glutamate), member 22
  ENST ID: ENST00000526152
  CDS Start-End: 184-565
gaaaggaagccaggtggtcccagggaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctga

SEQ ID NO: 183368 - DNA, 741 bp, Homo sapiens
  Payload ID: 16126
  Gene Symbol: SLC25A22
  Gene Name: solute carrier family 25 (mitochondrial carrier: glutamate), member 22
  ENST ID: ENST00000528606
  CDS Start-End: 211-741
ccccttctgtgtgagtgctgggctggagtgtggaagagccatccagagacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctg

SEQ ID NO: 183369 - DNA, 1790 bp, Homo sapiens
  Payload ID: 16126
  Gene Symbol: SLC25A22
  Gene Name: solute carrier family 25 (mitochondrial carrier: glutamate), member 22
  Uniprot ID: Q9H936
  ENST ID: ENST00000531214
  CDS Start-End: 548-1519
acatacgtgtccccgagggtgggtgtccggggcccgagcccaaggaagaaaggccgacccgtgtgggacgcacacgtgggagttcaccggacatctgtggacacgtgcgtggccggagtcgcggtggccaggcggaggacggagcggtcggctgagccccagcagtagggcaggggcctgagccggcctccgagcgcagagagcggcccccaacccgcttctcctttgtcctctggccgaggcatcgcgcagttggagtccccttccgggaccctccagccagcaggatagaaagcaccgccccaagaggacggggacagcgggagattgaatggggagccgccggccagactcggagcctcacccccattgcctttcttgggggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggc

SEQ ID NO: 183370 - DNA, 816 bp, Homo sapiens
  Payload ID: 16126
  Gene Symbol: SLC25A22
  Gene Name: solute carrier family 25 (mitochondrial carrier: glutamate), member 22
  ENST ID: ENST00000625419
  CDS Start-End: 226-816
gcctggccctttaaaagccggagctggctggggtgcacgtgagccccgagcgtgagcggcgtgacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggat

SEQ ID NO: 183371 - DNA, 2692 bp, Homo sapiens
  Payload ID: 16126
  Gene Symbol: SLC25A22
  Gene Name: solute carrier family 25 (mitochondrial carrier: glutamate), member 22
  Uniprot ID: Q9H936
  ENST ID: ENST00000628067
  CDS Start-End: 281-1252
gaagcccggaggaggccgagggcggagcgcgcgcggcgccgagcggacgcgcctccccgcctaggtgctggccgagcgcggggcgggcaggcgagcgcggcggcggcggcgagcgtggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtaga

SEQ ID NO: 183372 - DNA, 579 bp, Homo sapiens
  Payload ID: 16126
  Gene Symbol: SLC25A22
  Gene Name: solute carrier family 25 (mitochondrial carrier: glutamate), member 22
  ENST ID: ENST00000629634
  CDS Start-End: 288-579
agtgctgggctggagtgtggaagagccatccagagtgagtgcctggggcagagtgagagcaggaccagcgggcaggtggcggagcgggggtcggtggtggatggcccagccctggaaagccgaggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacg

SEQ ID NO: 183373 - DNA, 1021 bp, Homo sapiens
  Payload ID: 16126
  Gene Symbol: SLC25A22
  Gene Name: solute carrier family 25 (mitochondrial carrier: glutamate), member 22
  ENST ID: ENST00000627843
  CDS Start-End: 281-1021
agtgacggcttcagtctggggtggtgggtgaggggctgcgtgagagagggaggctgggggaggattactcttcgggtggccccaccctcactcattcccattccctcatccttctaggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgat

SEQ ID NO: 183374 - DNA, 709 bp, Homo sapiens
  Payload ID: 16126
  Gene Symbol: SLC25A22
  Gene Name: solute carrier family 25 (mitochondrial carrier: glutamate), member 22
  ENST ID: ENST00000625752
  CDS Start-End: 357-709
gtgagtgctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccgaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggt

SEQ ID NO: 183375 - DNA, 1841 bp, Homo sapiens
  Payload ID: 16127
  Gene Symbol: SLC25A31
  Gene Name: solute carrier family 25 (mitochondrial carrier
  adenine nucleotide translocator), member 31
  Uniprot ID: Q9H0C2
  ENST ID: ENST00000281154
  CDS Start-End: 169-1116
gcagcttttccgcacgcgcctcgccggcgcgcggctctctcagcgtcccaagagccactttctcgccagtacgatgctgcagcggttttccggttttccgcttcccttcatcgtagctcccgtactcatttttagccactgctgccggtttttatatccttctccatcatgcatcgtgagcctgcgaaaaagaaggcagaaaagcggctgtttgacgcctcatccttcgggaaggaccttctggccggcggagtcgcggcagctgtgtccaagacagcggtggcgcccatcgagcgggtgaagctgctgctgcaggtgcaggcgtcgtcgaagcagatcagccccgaggcgcggtacaaaggcatggtggactgcctggtgcggattcctcgcgagcagggtttcttcagtttttggcgtggcaatttggcaaatgttattcggtattttccaacacaagctctaaactttgcttttaaggacaaatacaagcagctattcatgtctggagttaataaagaaaaacagttctggaggtggtttttggcaaacctggcttctggtggagctgctggggcaacatccttatgtgtagtatatcctctagattttgcccgaacccgattaggtgtcgatattggaaaaggtcctgaggagcgacaattcaagggtttaggtgactgtattatgaaaatagcaaaatcagatggaattgctggtttataccaagggtttggtgtttcagtacagggcatcattgtgtaccgagcctcttattttggagcttatgacacagttaagggtttattaccaaagccaaagaaaactccatttcttgtctcctttttcattgctcaagttgtgactacatgctctggaatactttcttatccctttgacacagttagaagacgtatgatgatgcagagtggtgaggctaaacggcaatataaaggaaccttagactgctttgtgaagatataccaacatgaaggaatcagttccttttttcgtggcgccttctccaatgttcttcgcggtacagggggtgctttggtgttggtattatatgataaaattaaagaattctttcatattgatattggtggtaggtaatcgggagagtaaattaagaaatacatggatttaacttgttaaacatacaaattacatagctgccatttgcatacattttgatagtgttattgtctgtattttgttaaagtgctagttctgcaataaagcatacattttttcaagaatttaaatactaaaaatcagataaatgtggattttcctcccacttagactcaaacacattttagtgtgatatttcatttattataggtagtatattttaatttgttagtttaaaattctttttatgattaaaaattaatcatataatcctagattaatgctgaaatctaggaaatgaaagtagcgtcttttaaattgctattcatttaatatacctgttttcccatcttttgaagtcatatggtatgacatatttcttaaaagcttatcaatagatgtcatcatatgtgtaggcagaaataagctttgttctatatctcttctaagacagttgttattactgtgtataatatttacagtatcagcctttgattatagatgtgatcatttaaaatttgataatgactttagtgacattataaaactgaaactggaaaataaaatggcttatctgctgatgtttatctttaaaataaataaaatcttgctagtgtgaatatatcttagaacaaaaggtatcctcttgaaaattagtttgtatattttgttgacaataaaggaagcttaactgttataaagga

SEQ ID NO: 183376 - DNA, 4440 bp, Homo sapiens
  Payload ID: 16128
  Gene Symbol: SLC25A4
  Gene Name: solute carrier family 25 (mitochondrial carrier
  adenine nucleotide translocator), member 4
  Uniprot ID: P12235
  ENST ID: ENST00000281456
  CDS Start-End: 133-1029
aagggggagctgcgggccaggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttctattttattgaactcttattaactgtaaaatgcatttttaaaagatcaaaaatgcatattttctagcatgattcatgtatcagtcagcagccaagcttctaaatgccagatattatattgagaatgtattatatgagaacgtacaatgcttaaagttccggttttcaaacttaggcaggtcatattctatctatcttatccagcattactgtaggctagaaagtgataatggctttcataatcctgccttgtcttaggcactttcctgcagtctttagaaattctaagattctgctaaaagttttaaatcacaatctggagaattttctatgattaggaagtgctctgttttcatccctttagataactgtgacacctagaattttatgttaagtagagagtattcattgaaaatcaaggccaggtgcagtggctcacacctgtcaccccagcactttgggaggcagaggtgggcgtatcacttcaggccaggagtttgagaccagcctggccaaccgagcgaaaccccatctctaataaaaatacaaaaaattagctgggtgtggtggcgcacacctgtaatcccaactactcaggaggctgaggcatcagaatcacttgaacccgagaggcagaggttgcagtgagctgagatggcatgccaccacatccatcctaagcgacagggcaagactctgtctcaaaaaaaaaaaaaagaaagaaaatcagttgtcttagtttaagctactataacaaggtactgtagactgatggcttataagcaacagaaacttatttctcagttctgtagtctggaggtccaagatcaaggtgacactgtggtcaggttctgatgagggccctcttctgggttataaactacggacttcttgtatccttacatggcagaaagagcgacagagctctctgtagtcccttttataagctcactaatcccattcatgagggccctaccctcatgacccaattacctcccaaatgcccctcctccaaacaccaccactttgggggttaagatttcaacagatgaattttgaagggacacaaacattcagtccatagcatcacttatcaagctagtatttaatacctcttaggccccgtggaagggaaaatagataggaacctgccctgaaagatgcttcagttggggagaaaaggtgaaattccattgttagacaatttgtttaagacaatacatcttgcttgagaaggaatagaagggaaatgaaatggggggagggagtggtaggagatggaggctttgaaagaaaataaccagatttagaaacatgggtatagaaagcatcctccagtacttctgtaacaatttatcaagacctacaggaagtcagttttggatttgctcctccgagatttgcgagccagaggaaaatacttagactatcaggttggaaagttcacacttggaccaggaaaagaccaagcagttgctatagtctcctggattgtgactaatctggaggaagcaagtccctgtatccttggcaaagcttgaaaggcaggcaaatgtcttctctgtgttttctgacaggtggttgggtggtgggggttggtctctgtacctcctgttctttaccttgcttaccaagcccttccaccgactcactcctgcctccccagctaaaaattggctgtgttgcttttaccacagttaccaaggtctgagttttataaaatccaggatcacatctgacctcacctggtagatatctaggccaataaagtctaaagggctaaaaagaaggtacctctccatcctgtctcctcgaggccaggcagcacatgtgcagttaagaggcctcctggatccattgtcctcctgttgcttttcgttctaagtgatccaaactctattgctgatagggaataaaagcagggcaggctagtagtgggcaagtgctttgatggagcgtatctccaagcagggcccaagtttaggaggaggaagacctgatacaatgaatgaacagtgcgtcctcccaacccaaccaagaagtgtaattgtgttccgtctttaaccctggcatggaatggggagggaagaggcatggacatttattacatagtgcacattatctacattctctgcatgtgacccagatgtcagcccttccgcttcctgcgaaggttacctctaatgcacgttgccccaggccctgctgagctagttcctcaccgcagctacttaactcaccatgaattcctagaaccctcagcctctgagagtgctgggatctggcgggagaacaggcagtacttccctcactaacctacccgcacgccataccatcattgtgcaaagctgcctcatgctggaaggtctggtttacgtaaaagtgacaagttggaattgagcgtccgactctcgggtacctgccccaggcatttctcatcagccccatttcccacacagctctctcctaggcgcagccctccttcaccaccaccacccccaccccaatcacctttaggtattttctcccctaaagcctcacctgttggcattttacatctttttaagaccttattttgtattttaaatgtatgagaaaaattatggaggatgatgcaagatgagtgagtccataatggtaataattggacactaaaaacaatgaaaacttgtctcaagtatttgtgttgaaatctcaattaactgggcgactgctcccgttccattttattctgtaaaatatgtggcatcctttgtgttgaggcggcatttactaaacacccccaaggtgcaaggctgcaagagaatcgagcgccgcaaggcgagcttatcttccacacctggtacagtgcccaggacagagaaggtgtttagcaagtttctgctgaatggaagagtgagcgagaagggaaagtgcatctaaaaagcacagggaacctacaaaatatttgggaaagggtttcatcagttcgggtgaaatcttgaacgtgcaaagcaccatgggggtggctggacaggcttgttggagtcgtataatgcaatgaataaaaacttacggctgccttaaatgcaaatgtcaagcccttaaataaaatttaacaaagtc

SEQ ID NO: 183377 - DNA, 1666 bp, Homo sapiens
  Payload ID: 16128
  Gene Symbol: SLC25A4
  Gene Name: solute carrier family 25 (mitochondrial carrier
  adenine nucleotide translocator), member 4
  ENST ID: ENST00000491736
  CDS Start-End: 96-722
tcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaat

SEQ ID NO: 183378 - DNA, 1274 bp, Homo sapiens
  Payload ID: 16129
  Gene Symbol: SLC25A5
  Gene Name: solute carrier family 25 (mitochondrial carrier
  adenine nucleotide translocator), member 5
  Uniprot ID: P05141
  ENST ID: ENST00000317881
  CDS Start-End: 117-1013
agctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 183379 - DNA, 2062 bp, Homo sapiens
  Payload ID: 16130
  Gene Symbol: SLC25A6
  Gene Name: solute carrier family 25 (mitochondrial carrier
  adenine nucleotide translocator), member 6
  Uniprot ID: P12236
  ENST ID: ENST00000381401
  CDS Start-End: 716-1612
gcagcgggactgagccgcgcccacgtggaagccgccgcaggcttcgcgcggggccccccgggtgcacgcgggcaggggccggggtctcccgacgcacgaccccggagagtgttgaaagggtcggagctgcccggaggtcaagggtcaagggtcgggggtcggggcaccacatgtcgcacatcccggcggggtcgccgcggcctccgggagaaagcggacgacgcactcggagcgaactgggcatcagggtgggcttctgactccgcagctgccctcccgcccgctcgggtactggcagcggcctgaccttcacaaggtcaaggctgccgcggaacccccagcggcccctacggcgcatgggcggggcctggctcccggcatacctaggggtgcggggcgggacgtctccggggagcgcagccaatgggcgcggttcgctggagtgcggggcgggacgcagcgggattcccggcagccctcagaggcgaggcacgcaggctggtgtggggcggggcctggcggcgcagccaatgagcgcggcgcgaggaggcgcgggggcggagagtgggcgtggcgtcggcgtcttagcggctgcgcggtggctgctccgtcctttcggtccaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtc

SEQ ID NO: 183380 - DNA, 1648 bp, Homo sapiens
  Payload ID: 16131
  Gene Symbol: SLC25A1
  Gene Name: solute carrier family 25 (mitochondrial carrier
  citrate transporter), member 1
  Uniprot ID: P53007
  ENST ID: ENST00000215882
  CDS Start-End: 158-1093
ggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcagcctcc

SEQ ID NO: 183381 - DNA, 1514 bp, Homo sapiens
  Payload ID: 16131
  Gene Symbol: SLC25A1
  Gene Name: solute carrier family 25 (mitochondrial carrier
  citrate transporter), member 1
  ENST ID: ENST00000451283
  CDS Start-End: 351-977
gctgaggccccgccccacttccgggttgggccgtgggctggggagtcgtggaggcgcggtcctggtccccacccggcgcgctgggactcgcccgcctcccgtctgtcaccccctgcgcctcgccgggacaacggggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccg

SEQ ID NO: 183382 - DNA, 1946 bp, Homo sapiens
  Payload ID: 16132
  Gene Symbol: SLC25A10
  Gene Name: solute carrier family 25 (mitochondrial carrier
  dicarboxylate transporter), member 10
  Uniprot ID: Q9UBX3
  ENST ID: ENST00000331531
  CDS Start-End: 121-1011
cgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcagccgctggtgacgagccccctcctcagggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 183383 - DNA, 1885 bp, Homo sapiens
  Payload ID: 16132
  Gene Symbol: SLC25A10
  Gene Name: solute carrier family 25 (mitochondrial carrier
  dicarboxylate transporter), member 10
  Uniprot ID: Q9UBX3
  ENST ID: ENST00000350690
  CDS Start-End: 87-950
cggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 183384 - DNA, 1911 bp, Homo sapiens
  Payload ID: 16132
  Gene Symbol: SLC25A10
  Gene Name: solute carrier family 25 (mitochondrial carrier
  dicarboxylate transporter), member 10
  ENST ID: ENST00000545862
  CDS Start-End: 192-1412
aatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgccacatc

SEQ ID NO: 183385 - DNA, 726 bp, Homo sapiens
  Payload ID: 16132
  Gene Symbol: SLC25A10
  Gene Name: solute carrier family 25 (mitochondrial carrier
  dicarboxylate transporter), member 10
  ENST ID: ENST00000574884
  CDS Start-End: 1-340
gcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaaggagagatcttcaggcccatgaggcctctgcttcctcgagaacccccggcctgcctcggggcctgggaggaccctctgtgggagccggtggtcagggggagtctcatgtggtcattctgtgtccccggcagctacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggg

SEQ ID NO: 183386 - DNA, 1523 bp, Homo sapiens
  Payload ID: 16132
  Gene Symbol: SLC25A10
  Gene Name: solute carrier family 25 (mitochondrial carrier
  dicarboxylate transporter), member 10
  ENST ID: ENST00000574129
  CDS Start-End: 164-283
cgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaagggacagccaaggggcgttgttttctgaccgtgtcttgccacagagaacaaagaagaaagggcctgaggctttgcacagtctgcccagcaggccctgccctgtgaacctggctgtggtcactgggcagccgcctgtctaggggacctttattttagcagcctgtccaggggacttgtattccagcagcctttgaggggactggctttactaatgagcaacaatgctggtcgctgcgtgaaggccaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctct

SEQ ID NO: 183387 - DNA, 1586 bp, Homo sapiens
  Payload ID: 16133
  Gene Symbol: SLC25A15
  Gene Name: solute carrier family 25 (mitochondrial carrier
  ornithine transporter) member 15
  Uniprot ID: Q9Y619
  ENST ID: ENST00000338625
  CDS Start-End: 237-1142
gggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaaccca

SEQ ID NO: 183388 - DNA, 468 bp, Homo sapiens
  Payload ID: 16133
  Gene Symbol: SLC25A15
  Gene Name: solute carrier family 25 (mitochondrial carrier
  ornithine transporter) member 15
  ENST ID: ENST00000417731
  CDS Start-End: 70-468
ggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtacagtgtggtctgtcatcaaaagtattcttaggaaagatggccccttggggttctaccatggactctcaagcactttacttcga

SEQ ID NO: 183389 - DNA, 511 bp, Homo sapiens
  Payload ID: 16133
  Gene Symbol: SLC25A15
  Gene Name: solute carrier family 25 (mitochondrial carrier
  ornithine transporter) member 15
  ENST ID: ENST00000470509
  CDS Start-End: 70-243
ggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccgg

SEQ ID NO: 183390 - DNA, 1417 bp, Homo sapiens
  Payload ID: 16134
  Gene Symbol: SLC25A2
  Gene Name: solute carrier family 25 (mitochondrial carrier
  ornithine transporter) member 2
  Uniprot ID: Q9BXI2
  ENST ID: ENST00000239451
  CDS Start-End: 181-1086
cggagcgtagggttgagcggcttcccccgcactggggtgagagcccagaacaggcggtagagccaccccaccacccccaactccattccccgcgctcgctgcggctggacgtgaaaagccggtctcacgctctggggagttagtcgccttccactgggaccctcagacgagtgagcgaacatgaagtccggtcctggcatccaagccgccatcgacctcacagcgggggccgcaggggggacagcgtgtgtactgactgggcagcccttcgacacaataaaagtgaagatgcagacgttccctgacctgtacaagggcctcaccgactgcttcctgaagacatacgctcaagtgggtctccggggcttctacaagggcaccggcccggcacttatggcctacgtcgccgaaaactcggtcctcttcatgtgctacgggttctgccagcagtttgtcaggaaagtggctggaatggacaagcaggcaaagctgagtgatctccagactgcagccgcggggtccttcgcctctgcatttgctgcactggctctctgccccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttgtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagagtacaagaccactgtctaattttgacttcatgggaattttggttttatcttcccttcttctaccctaaatcttaactttatggaagggcctctattttacatcatataatttctgcccataattgtattgaaataggaaagttgctgctcttgcacttgctggaatgtacagggtgggctggttggccctatgtacctaatctgaaaaactaaatatcgttctgtcagggcctttgcataaagccatttgtgtgtacatgca

SEQ ID NO: 183391 - DNA, 1897 bp, Homo sapiens
  Payload ID: 16135
  Gene Symbol: SLC25A11
  Gene Name: solute carrier family 25 (mitochondrial carrier
  oxoglutarate carrier), member 11
  Uniprot ID: Q02978
  ENST ID: ENST00000225665
  CDS Start-End: 342-1286
aacttggcgagccgtactcactcgatctcgcgagaccttcaaacaaactcttctctattttcccgcgattctaattcggtgaaaacagcgcctttcctctggtttccaaatcagttacgccccttctcgcacgcttccatcaagctcctccttcagctccgccttactcccggccgcctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagccccaaatctggagagtctggggggtggctaggagaggggaggagactggacaaagaagctggagaataggaactggagtttttaagaaaaattgttaaagaaaaagcagccgctggttttttgcaaatgctgtataaatctgtcatgccacagcagctgacagggccagaaaaactcaaa

SEQ ID NO: 183392 - DNA, 952 bp, Homo sapiens
  Payload ID: 16135
  Gene Symbol: SLC25A11
  Gene Name: solute carrier family 25 (mitochondrial carrier
  oxoglutarate carrier), member 11
  Uniprot ID: Q02978
  ENST ID: ENST00000544061
  CDS Start-End: 144-935
ccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctccc

SEQ ID NO: 183393 - DNA, 893 bp, Homo sapiens
  Payload ID: 16135
  Gene Symbol: SLC25A11
  Gene Name: solute carrier family 25 (mitochondrial carrier
  oxoglutarate carrier), member 11
  ENST ID: ENST00000576951
  CDS Start-End: 4-893
gcgatggcggcgacggcgagtgccggggccggcgggatagacgggaagccccgtacctcccctaagatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaa

SEQ ID NO: 183394 - DNA, 2058 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000263255
  CDS Start-End: 83-274
gagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactgagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatc

SEQ ID NO: 183395 - DNA, 2405 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000402844
  CDS Start-End: 982-1659
gtttatccttggttagactgtatttcctatatataatattttgagataccttaaatcaaaactttatttcttcaattatctttaaatggattttagtaaaagacttctcttccttaggattttttctcttggttcttcagatcttgactagagccagacagttggatgtgtgcttttttactgagtttgttcattgcttcatttgttccactatttatttaacaaatgtttataaagtatataccatgtgtcaggcacattgttacaattctatctggtatttttttttaatcatttcaggactggtgaggaatattttaatatctcaagatggtgttaaattgggatcatatgttttcaaaaaagaagcacctggctcattgtattgttctactctgaggcaaccttggggggccaagatccccatccttaagcttgtaaggatcatgatgcttgtgaagctgtttcaggtgttttgtgacacttacctgatgcttgctgcctgcctatcctaatgctctcagcaaggaggaactcttcagcgagcttctagtctctgttaaggcacttttaaatgtcaccacctttccccctcctgtcactcattgtaccatatccatactcacttcaaaccgtgtgagctacttaagtaagagttgtaaattgtgtgttttatctgatattgtcatggacttagcatgttagctgtaagccactctcatctctaaagctgttacgttaaaattatatttaaagctatatcaaaattgctactttgaatggtatataaattgacaaatagattgcctgttgtacaaatgagggaacttattgctcttcatctggagagctgctgccgccagccattttgctatcagcaaagcttccaaatcgcttctaacagtagtggcttgtgttgtaccctggcacaaagagacaccttaccttaggtctcctaagaggtcagtgacagagatataaatggaatattggtatgtagctttaaagcagcaaagcttaaaagctgacattttgccttccctttttctctccatctttcttgttaaaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcac

SEQ ID NO: 183396 - DNA, 801 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000458600
  CDS Start-End: 152-289
gcgacccggaagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggatttgttcaagttgaaattgtaaacctatgccagaacttgcatgaagagatgattgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaag

SEQ ID NO: 183397 - DNA, 641 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000426396
  CDS Start-End: 85-531
ctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcagatgggggtctttctgtgttgcccaggctggtttcaaacccctggcctcaagagattcttctgcctcgaccttccaaagtgctaggattacaggagtggttaatgtgttgctaacaactccactctgggtggtaaacaccagactgaagcttcaaggagcaaaatttaggaatgaagacattgtaccaacaaactacaaaggtatcattgatgcttttcatcag

SEQ ID NO: 183398 - DNA, 1243 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000447566
  CDS Start-End: 103-234
gattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatata

SEQ ID NO: 183399 - DNA, 2262 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  Uniprot ID: O43808
  ENST ID: ENST00000435456
  CDS Start-End: 135-1058
ctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatc

SEQ ID NO: 183400 - DNA, 1060 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000420970
  CDS Start-End: 79-798
tccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggttatttatccattcaaatatttactaagcatccacactgtgggaggacctgggcatgcagtggtaaataaaagtcataatccctgcccttatggagctagtggaagagagaatgaacagtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgttta

SEQ ID NO: 183401 - DNA, 561 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000412879
  CDS Start-End: 142-288
agtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatct

SEQ ID NO: 183402 - DNA, 565 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000434185
  CDS Start-End: 290-565
aggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgttgtgactcccggccaggcacagtggctcacacctgtaatcccggcactttgggaggcctgaggcgggtggatcatgaggtcaggagatcgagaccatcctggctaacatgggaagcgtgacagcaatgacagtgttttttcccctggatacagctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggttt

SEQ ID NO: 183403 - DNA, 734 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000430221
  CDS Start-End: 69-218
ctttcctaactccactggctgcggcatctgtgggaaaagtgtggctgggtcttcgaggagccgcaccaatggcttccgtgctgtcctacgaaagcctggtccacgccgtggccggagccgtgctagacttcgacttcaggcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaag

SEQ ID NO: 183404 - DNA, 533 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000449676
  CDS Start-End: 99-236
gcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggatttgttcaagttgaaattgtaaacctatgccagaacttgcatgaagagatgattgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacacca

SEQ ID NO: 183405 - DNA, 598 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000434193
  CDS Start-End: 90-227
acaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggatttgttcaagttgaaattgtaaacctatgccagaacttgcatgaagagatgagtaagattagctttcaatagtaattcaaagttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgta

SEQ ID NO: 183406 - DNA, 593 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000443810
  CDS Start-End: 133-270
agggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcaggatttgttcaagttgaaattgtaaacctatgccagaacttgcatgaagagatgagtaagattagctttcaatagtaattcaaagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttgg

SEQ ID NO: 183407 - DNA, 749 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000427084
  CDS Start-End: 120-290
gggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgctagacttcgacttcaggttgatgagaaaagaaaatccaaaactacacacatggtgctcctggagatcattaaagaagaaggactcctggcaccatatcgagggtggtttccagtgatttccagtctctgctgctccaattttgtctatttctacacttttaatagcctcaaagcactctgggtcaaaggtcaacattctaccactggaaaagatctggtagttgggtttgttgcaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcaga

SEQ ID NO: 183408 - DNA, 2060 bp, Homo sapiens
  Payload ID: 16136
  Gene Symbol: SLC25A17
  Gene Name: solute carrier family 25 (mitochondrial carrier
  peroxisomal membrane protein, 34kDa), member 17
  ENST ID: ENST00000544408
  CDS Start-End: 152-856
gcgacccggaagtggttctagggcaggcgggcgggtttgagagggcggggattgcgactctcacaccctgagctccggtgctcctttcctaactccactggctgcggcatctgtgggaaaagtgtggctgggtcttcgaggagccgcaccaatggcttccgtgctgtcctacgaaagcctggtccacgccgtggccggagccgtgggaagcgtgacagcaatgacagtgttttttcccctggatacagctagacttcgacttcagggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtagtactgccacaagctgagagcttgctgggcacgcaacccagagtttctgaatcctgttccgtattttaacattcccaggtgattcacagccacattaaagttcaggagaccataggacccctgacccatgagaagaagtgattggtttcgattatagacatcaagataaagatttttctcaaaggaaagagattaatgtattaaaacaacctctgaaaaatc

SEQ ID NO: 183409 - DNA, 2056 bp, Homo sapiens
  Payload ID: 16137
  Gene Symbol: SLC25A23
  Gene Name: solute carrier family 25 (mitochondrial carrier
  phosphate carrier), member 23
  Uniprot ID: Q9BV35
  ENST ID: ENST00000264088
  CDS Start-End: 124-1572
ggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacgctctcttctgctgggttctctgcctggataaaagattctacggctgaacagaatcgttcaaaaaccacggtcttggccaggcgcagtggctcacacctaaaatcccagcactttgggaggccgaagtgggcggatcacgaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggctggagtacagtggctcgatttcagatcactgcaacctctgccttccaggttcaagcgattctcctgcctcagcctccagagtagctggtattacaggatttcatcatgttgcccaggctcatctcgaactcgtggggtcaaggaattcgccagccttcagcctcccaacgtgctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaatacatatatacctacatgta

SEQ ID NO: 183410 - DNA, 3425 bp, Homo sapiens
  Payload ID: 16137
  Gene Symbol: SLC25A23
  Gene Name: solute carrier family 25 (mitochondrial carrier
  phosphate carrier), member 23
  Uniprot ID: Q9BV35
  ENST ID: ENST00000301454
  CDS Start-End: 108-1514
gcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctcttt

SEQ ID NO: 183411 - DNA, 1424 bp, Homo sapiens
  Payload ID: 16137
  Gene Symbol: SLC25A23
  Gene Name: solute carrier family 25 (mitochondrial carrier
  phosphate carrier), member 23
  Uniprot ID: Q9BV35
  ENST ID: ENST00000334510
  CDS Start-End: 108-1424
gcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagatgtgtcagtgtacaagacggacacggtccccaccctcatagagctcacaggccggagaggaaggaagatgctaaataaatcattctggaattaa

SEQ ID NO: 183412 - DNA, 1210 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000600682
  CDS Start-End: 1-709
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggatt

SEQ ID NO: 183413 - DNA, 526 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000601322
  CDS Start-End: 1-300
aatgtactcaagattgcccccgagtcagctatcaagttcatggcctatgaacagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggttcaagcgattctcctgcctcagcctccagagtagctggtattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgc

SEQ ID NO: 183414 - DNA, 834 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000593600
  CDS Start-End: 1-834
tccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggagcacggattccctgtacctcaacacccagaccctgcctccctcaggcaccagatccagtgtcctagtgaaacgctggatcctagatccccaaccccagatccccatgcctcgagccctggatctccaagctcagctgctgg

SEQ ID NO: 183415 - DNA, 888 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000598908
  CDS Start-End: 1-649
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggatttcatcatgttgcccaggctcatctcgaactcgtggggtcaaggaattcgccagccttcagcctcccaacgtgctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaatacatatatacctacatgta

SEQ ID NO: 183416 - DNA, 557 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000597307
  CDS Start-End: 327-557
aaaacaaatctaagactgaatggctggggtctacaccttcagccaaccaggtcgacccggctcggcaggcctcctcccagctcccagttcacccaaaaacacctgcactataccaagactcagtggtcatcaggactggggagaatgacttaacctccgcttccttatctgcaaagtgcgaacgccagtaccacctaccttatagggttttggcaaagacgactcgagagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacg

SEQ ID NO: 183417 - DNA, 736 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000598704
  CDS Start-End: 1-272
gtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagatgcagtttcgctctgtttcccaggctggagtgcaatgacgtgatctcagctcactgcaacctccgcttcccgggttcaagtgatcctcctgcctcagcctccagaatagctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaatacatatatacctacatgtata

SEQ ID NO: 183418 - DNA, 734 bp, Homo sapiens
  Payload ID: 16137
  Gene Symbol: SLC25A23
  Gene Name: solute carrier family 25 (mitochondrial carrier
  phosphate carrier), member 23
  ENST ID: ENST00000595810
  CDS Start-End: 1-395
cagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaatacatatatacctacatgtata

SEQ ID NO: 183419 - DNA, 3320 bp, Homo sapiens
  Payload ID: 16138
  Gene Symbol: SLC25A24
  Gene Name: solute carrier family 25 (mitochondrial carrier
  phosphate carrier), member 24
  ENST ID: ENST00000264128
  CDS Start-End: 142-474
gcagccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggagaaaatttttactactggagatgtcaacaaagatgggaagctggattttgaagaatttatgaagtaccttaaagaccatgagaagaaaatgaaattggcatttaagagtttagacaaaaataatgatgcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaatta

SEQ ID NO: 183420 - DNA, 3404 bp, Homo sapiens
  Payload ID: 16138
  Gene Symbol: SLC25A24
  Gene Name: solute carrier family 25 (mitochondrial carrier
  phosphate carrier), member 24
  Uniprot ID: Q6NUK1
  ENST ID: ENST00000370041
  CDS Start-End: 198-1574
gaagccgttaggatgagccctctccttccagagctttaaccgatgaaggtgcattgtgtttggcgcccctgaggaggatgctgtcttaggcctcttcccactggacgtgtgtggtgggcagagatcccgttcgtcggtcgcacttccaccccgctggggctcactcaggccgcggagctgcgagggagacatcctcgatggactccctctacggagatctcttttggtacctggactataacaaggatgggaccttggacatttttgagcttcaggaaggcctggaggatgtaggggccattcaatctctagaggaagcgaagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaa

SEQ ID NO: 183421 - DNA, 2357 bp, Homo sapiens
  Payload ID: 16138
  Gene Symbol: SLC25A24
  Gene Name: solute carrier family 25 (mitochondrial carrier
  phosphate carrier), member 24
  ENST ID: ENST00000569674
  CDS Start-End: 712-921
acgcagatggctgttgatcttttctgcaacaaatccaggagtttctcctttttgttttataattgctccaatagatgctttaggatttaactctctgctttttaaagcagaatcgccatcccaggtgtgcaaccacgaaaaaattagacatccgtgagagacaatgccctccatggcccagtttccaggcagagagaagcagctctgggctgaccgccaaggctccggcccgagagggtctttaagtggagtaaccagtcttcaagaccccgctcccaagccaccgacgcgctgacgctgcagccctggacctgctgggggcctcttcctcggacccgcatgctgacagcgggactggcaactgggcagaggtcgaccccgggtccgcacagcacctcccgagacccagctcccagctccctcacttccggctctctggaggcgggcccggccagtgccgccgaggccagcgcggcgagctcctccccagcagcggcgggacggccacaccctgcgctccgcgcgggctcgggtggggtctccgctcctgcgccctgcgccctgcgcgccgcagccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggaggtgggtcgccgccggggcgccgcctgagcgtagggagggctgcgggcgctggggacactgcgaggaccgaggagggcggcggcttgaggcgttgccaggagaggaaggaggaactgtggcgcccagcgctccggtggcttcagaaactcgggcgtggggccgcgaccggcgaccccggtaacagaagtgggtcataatacgaaagtctactggtatttgtccagataaaatgagtgttgtggacactctggcccacgggcactgttaaatttttaagacacttttgtcctgaatccatcccaggttctttgttttctgttttaataccttgcagacatgtaatccgttttagctgtcagacttcagtgggtcccaagttttgtataaaggcgcacacattcgatctctttcgaagctgctttgttacagcagctatgtgtattgtctactgtttgaaaactgtttgaaaaccaatcgcgtgtttcccccacttcctgttgagaaggaatggcggcattccattgtttaagacattcctaggttaatgccctaggtacataaattgatctgaagggttgacttgacctgcgactgagcaatttcattttctctgagtcatcttaactgtgcccctgaacttctgcccctttagtagggtggagatatgtggaacttctccaaccctgttgaagcgttccctgacactggcattctcttatccaaagagggaaagtgattaggttactatgagggccaacaactgttatatagttatatttcacttctcttttaatgtctttggtagttataggcctcttcagtttactgtttcttctagagtcagatttagtaagttacaattttttttgaaactgcctgttctgtccaaggttcataatactcaccgatgattttataacacttctgactgaatctgtaggtaggttctctatttcattcctcatatctatccttttctccccttcaatcttgccaaagttttgtgtattttattcatactttgaaggaaccaacttttggtactttgtgctgattgtcccagaaatggcccagttggagttccccaccatgtccaatcattggctggaagcagcccaggaaagggacgaccttgctgcagtgcatcagcagatgccagggttagaggctagagagtggaagtcaactgtgttcctcacagtaggtgcctttgaagggagatctcagtggtacaactccatggtccctacaatatacaaaagctctttggagtgctcaatgatttttaagattgtaaagggatcctgagatcaaaaagcttgagaattgctgctgtatcaccatttttacgtaactgcatcatattctgttatatgtttgtgtcatagtatatgttaccaattctttttaaatcaccttttactttattgatagtttaaaaacgattgtaagtgaaattgcaa

SEQ ID NO: 183422 - DNA, 4271 bp, Homo sapiens
  Payload ID: 16138
  Gene Symbol: SLC25A24
  Gene Name: solute carrier family 25 (mitochondrial carrier
  phosphate carrier), member 24
  Uniprot ID: Q6NUK1
  ENST ID: ENST00000565488
  CDS Start-End: 221-1654
agcggcgggacggccacaccctgcgctccgcgcgggctcgggtggggtctccgctcctgcgccctgcgccctgcgcgccgcagccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaattacttgttttccagtttttattttttttagagaaaattcttaagtctcagtttcctaattgaaaaaaaaaaattataaataaagcaaaaattgtatcctacagcttagctagcttagatgtttggcaccagtttgaatcatgctttttacagctggctccatgtagtctttccaaacattttggcctttcctgagcagcccttgtagatattgtctgtatgatgcattttgacacaaggtgatattttttgtgatatcaaaattccacatttacccattagagttacagccctggggttcacagtaccaagggggacccagagcctcaggattggccaggctcattttgccgtggagtatcagtttgtcttgaaattgtgggaaaaaattctaagttgaattcactggtaagtaattttttaaaatttcataatgcagattacatccaaaatttgatttaaaaattaaaacataagactgcagagaaattctgcatttcaactccaatactatccagacttcagaaataacttatcagttatttctgtaagcttcttgcttacctggatacctgacaggtgagatggctgtagcagacactggcagttccctgcccacacacctgtccctgtccacagctgcacaaggcagctctgtgtgcaattgccagcatctgctcctctgttctcagggaatctttgttagaaaaatgctgccatatttgtttctcacctattagtcttgtctcccagtcaagagaataaatttatgcaagcagagattgta

SEQ ID NO: 183423 - DNA, 3474 bp, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENST ID: ENST00000373064
  CDS Start-End: 264-1673
cggtgacgtcagccctgatctttgtgcctctcacttgagcaacctgatgccaccttctcccccgggctctgtgttcattggctgttggcaggacttgccgtgggagggcttttttcttttttcaattaagtaaaagggcagggcttaagcagccaatgacagctgaggccaggcttgtcttatgcaagtttcccgggaccggcagcatttagggaacttgctcccggtggtgagggcagtggagcacccagcaggccgccaacatgctctgtctgtgcctgtatgtgccggtcatcggggaagcccagaccgagttccagtactttgagtcgaaggggctccctgccgagctgaagtccattttcaagctcagtgtcttcatcccctcccaggaattctccacctaccgccagtggaagcagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 183424 - DNA, 3714 bp, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENST ID: ENST00000373066
  CDS Start-End: 408-1913
gcgaggacagctgaataactgggagctcgaagttgcttgctgcctccgggagtggtctgcttggctgtcgcgttttccttttctttttttttttttttaaaaaaaagccaaacgtttgctcaccatcacctgcagaagtgagtttttattgaagaagctccagctgctttctccttattgccggcagcctggcaagcctcccttagagtgagctacttctcaggccgggcacgacagcagtgctagcacatttgaaaaagcaggaaaccgcccctgcatgcagagcttccagcctgagaaccccaggcccgtcctcccagcagctgtgtagccagagagcgttggtactgtggtcacatccctcaaaagtgaacagtcgccatcagaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagaatacgaacgggccatttctggggccctgtcacctacatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 183425 - DNA, 3431 bp, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENST ID: ENST00000373068
  CDS Start-End: 120-1631
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctg

SEQ ID NO: 183426 - DNA, 3376 bp, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENST ID: ENST00000373069
  CDS Start-End: 28-1575
gcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagaatacgaacgggccatttctggggccctgtcacctacatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 183427 - DNA, 3678 bp, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENST ID: ENST00000432073
  CDS Start-End: 408-1877
gcgaggacagctgaataactgggagctcgaagttgcttgctgcctccgggagtggtctgcttggctgtcgcgttttccttttctttttttttttttttaaaaaaaagccaaacgtttgctcaccatcacctgcagaagtgagtttttattgaagaagctccagctgctttctccttattgccggcagcctggcaagcctcccttagagtgagctacttctcaggccgggcacgacagcagtgctagcacatttgaaaaagcaggaaaccgcccctgcatgcagagcttccagcctgagaaccccaggcccgtcctcccagcagctgtgtagccagagagcgttggtactgtggtcacatccctcaaaagtgaacagtcgccatcagaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 183428 - DNA, 905 bp, Homo sapiens
  Payload ID: 16139
  Gene Symbol: SLC25A25
  Gene Name: solute carrier family 25 (mitochondrial carrier
  phosphate carrier), member 25
  ENST ID: ENST00000466983
  CDS Start-End: 1-496
cacagtggaggagaggcagacggggatgtggtggagacacctggtggcaggaggtggggcaggggccgtatccagaacctgcacggcccccctggacaggctcaaggtgctcatgcaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaaggtaaggctggccctggacagtcccctgggaggtcggggggagcggacagaagcatctgactggtggcctccatcctgcagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttc

SEQ ID NO: 183429 - DNA, 676 bp, Homo sapiens
  Payload ID: 16139
  Gene Symbol: SLC25A25
  Gene Name: solute carrier family 25 (mitochondrial carrier
  phosphate carrier), member 25
  ENST ID: ENST00000472769
  CDS Start-End: 31-258
gggcagtggagcacccagcaggccgccaacatgctctgtctgtgcctgtatgtgccggtcatcggggaagcccagaccgagttccagtactttgagtcgaaggggctccctgccgagctgaagtccattttcaagctcagtgtcttcatcccctcccaggaattctccacctaccgccagtggaagcagtgcccactgtgcaccaagggggatttgcagatccaaggaaggagacagaaggaggcccaggccctgtgaggcagaagcaagcactttgagaatgcgttgaagccagctgcgaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtgg

SEQ ID NO: 183430 - DNA, 1909 bp, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENST ID: ENST00000188376
  CDS Start-End: 355-1440
gtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 183431 - DNA, 1678 bp, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENST ID: ENST00000228318
  CDS Start-End: 121-1209
gtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 183432 - DNA, 6087 bp, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENST ID: ENST00000401722
  CDS Start-End: 151-1236
accaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatgacagtaaaggaccaaagtgattgacagctgaaaacaattttcaggtacactaattctctttacacagatctgactttttttttttttgagacggagtttcactcttgttgcccagacgagtgtagtgtcgcgatctcgcctcacggcaacctctgcctcccaggttcaagcgattgttctgcctcagcctcccaagtagctgggatttcaggcatgtgccaccacgcccagctaattttgtatttttagtagagacggggtttccctgtgttggtcaggctggtctcgaacttccaacctcaggtgatccgcccgcctcagcctcccaaactgctgggattataggcatgagccaccgtgcccggctctgactttttacagaaaattgaactattttcagtctggtattttaagaaaggtactgcttgacagctgaactatatgaatgccactggggaaaaagcattccatcatacttagatacgagattggattgtaggtttaagcccatttttaaagagctcctagaaagtgaattagtttttgtgtttagattccccttaagtttgattaggaagtgtataaaagttcaatcttttgtaatgacagcccaccactggaaaaaaaacgaaaaacctagtgtaatatataacatgctgtttttcaaacactagattttacctagagtccttatgtgtaatacgtgggttggttaacagtccctacgtaaagcgtacagatggcctggagagaaaaactttttcagagattggagagaaatgttactacaaactcatggtaaggtcagtgaactcaatttagaagccagtgcagctagttgcatgttaacttctttatatcatcattgcctgaacttgttaaaggttccaacattttacctgtgctgcaggaaaaaaggaaaagttgtaggtacaaatttggaccaaactttaaaaaggtaaagtaggatgtcttctgaacccaaccaagtggtggctgtggtgcttagcagtatcaactgtatattatttcttgctatgttagcaaagcatccaaagatcaatggtgtatgataagcttttctgtgggtgaagaactcgggagtatcagactcttctggttctgagtctcatgaagcttttcacttctgagctgaaaggatgctctttgtgcttttcactattagtggtatagtctttcccgaaaatctctagcatggtggcttcagggcagctggacttaggtggtattttggggctccaggagagcttggcagagttggctttttaggacttatccttcaatgtcacataacatcacttttaccatgctcttggttacaacagtgatgtctcagaaaccaagtcccagattgaggaaaaaaggaacatagtctctacctcttcctgagaggaaagtcagtcaacgtgtaagaggagcagtagaaacgcattagtccagccaacgtgaaagtggaccgtagatctaaaacattttgggtatgcagttcagccagcccttactgaggcagttctgccaatcaggattcaagttttatttcctaagagttataataggttttatttgtgggcattgatacaaaatacgctgtgttcaagctatggagcctgccactgtagttactagagttacggttcaaagctatttctgagagaaagccacttcatcctcaaaacccaagaggcccacttaaagtgatgcgaattctcatttcaggtttttaaattatactaaaagattctagtaagaaaattttaatatgtatgtattggtgttctttttacatttcatttaatgaaatgtctactgtcaatacgataaagcagaacccagtggagtaagaatacacgaaactgccaggcacagtgggtcatgcctgtaaacccagcattctgggaggccgaggcgggtggatcacctgaggtcgggagttcaagaccagcctgaccaacatggagaaaccctgtctctactaaaaatacaaaattagctgcggtggtggtgcgtgcctgtaatcccagctactcaggaggctgaggcaggagaatcgcttgaacccgggaggcggaggttgtggtgagccaagattgcgccattgcactccagcctgggcaacaacagcgaaactctgtctcaaaaaaaaaaaatatatatatatatatatatatatgaagctgatagttgaattatgttgattcagggacaagatagcattgcatagtaacttccagtaggatcaaatattttgagagtggttaaaacgccaaggaatcctgattttatgaaattatgccttctgataggtgcaacaaaattgaacagaagagtaacagcttaactaaacctccattgtgtgaaagttttatgaaatgttttgacttttttttttttttccctagagaacagggttcttgctttgtcgcccaggctggagtacagccttgaactcctgggctcaagcgatcctcctgcctcagcctcccagttagctgacacaattgggatgtgccactacttgctcctgttttttcatagacgggtcctgctgttgctcaggctggtctcggattcctggcctcaagcaactttcctgccccagctcctaaagcggccagggttacaggtagccgccttgtctgtcccgtttcgaccatattttatttttgagaaggtcttgctctgtcgccagactggagtgcagtggcacgatgatagctcactgcagcctcgatctcccaagctcaagtgatcctcccacctcagcctcttgaataactgggactgcaagtgtggaccaccatgtctggctaatgttttttatttttagcagaaatgaggtcttgctatgttgccaaggctagtcttgaactcctgagctcaagcgagccttctgccttggccttccaaagggctgggattagagggctgagccaccacacttggccaaccatattttattttttatatttttattttatttgatccttgttctgaaaccataaagtgagtttaacatttctggctgggcacagtggctcatgcctgtaattctaacactttaggagaccaaggcaggaggatgccttgagcccaggagtttgagaccatcctggacaacataatgagaaaagaaaatacaaaaattaaggggtgtggtgacacatgcctgtagtctcaactatttgggaggctgaggcaggaggattgcttgagcccgagaggttgaggctacagtgagccatgtttacgccattgcagtccagcctgggcgacagagtgaaaccctgtctcaaaaaaaaagtaacatttctatatgatttttgggatcgacatgtccataatgttaatgaagcgcatagcagtcactagtaaattaggagttatacattgcttctatagcatcagaaattgtatatcaggccaggtgcaaaagctcactcctgaaatccaagcactttgggaggctgaggtgggcggattgcttgaggtcaggagttcaagaacagcctggccaacatgatgaaaccccaggtctctactaaaaatacaaaaattggtcaggcatggtggtgcatgcctgtaattccagctactcgggaggctgaggcaggagaattgcttgaacccgggaggcagaggttgcagtgagccaagattgtgccactgcactccagcctgggcgacagagccagactgtctgaggaagaaattgtatatcaggctgggcacagtggctcatacccgtaatcccagcactttgggaggcccaggctgggtatcacttgagcccaggagttggagaccagcctgggcaacaaagtgagacccctctctctacaaaaaataaattagccaggcatggtggcacgtgcctgtaatctcagctacttaggaagctgaaggaggatcgtctgagcccaggagtttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttcaaactatgtgttgaa

SEQ ID NO: 183433 - DNA, 1359 bp, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENST ID: ENST00000551917
  CDS Start-End: 92-1180
aagggcacacatcttaggacccggaggacgtccggcctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatg

SEQ ID NO: 183434 - DNA, 550 bp, Homo sapiens
  Payload ID: 16140
  Gene Symbol: SLC25A3
  Gene Name: solute carrier family 25 (mitochondrial carrier
  phosphate carrier), member 3
  ENST ID: ENST00000548046
  CDS Start-End: 90-550
acacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggaga

SEQ ID NO: 183435 - DNA, 1285 bp, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENST ID: ENST00000549338
  CDS Start-End: 54-1139
cgcaacctttccaagggagtggttgtgtgatcgccatcttagggagtgaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttca

SEQ ID NO: 183436 - DNA, 1351 bp, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENST ID: ENST00000552981
  CDS Start-End: 86-1171
atcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 183437 - DNA, 580 bp, Homo sapiens
  Payload ID: 16140
  Gene Symbol: SLC25A3
  Gene Name: solute carrier family 25 (mitochondrial carrier
  phosphate carrier), member 3
  ENST ID: ENST00000551265
  CDS Start-End: 56-424
ctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaaggtgagatcagaccctgcccaatacagtcgtgtggtctacttgtgggccgcccagcctttgaggcctggacccggcttggaggacagggaaggacgagtccagcccgctgcaccgtaggacggcgcccagttgcttgccctggggtatcggccttttccaccataggcgggtgtcagatccttggccttccctcaagggcgtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattac

SEQ ID NO: 183438 - DNA, 1417 bp, Homo sapiens
  Payload ID: 16140
  Gene Symbol: SLC25A3
  Gene Name: solute carrier family 25 (mitochondrial carrier
  phosphate carrier), member 3
  ENST ID: ENST00000551123
  CDS Start-End: 46-360
cgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtttgttttgcatgctggactagagcatattgaagcatgactgactgttaagttataagatatagtcatctaacaagctgtgtggaaacctaactgtccaggaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatg

SEQ ID NO: 183439 - DNA, 1369 bp, Homo sapiens
  Payload ID: 16140
  Gene Symbol: SLC25A3
  Gene Name: solute carrier family 25 (mitochondrial carrier
  phosphate carrier), member 3
  ENST ID: ENST00000548847
  CDS Start-End: 255-1229
atcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaaga

SEQ ID NO: 183440 - DNA, 756 bp, Homo sapiens
  Payload ID: 16140
  Gene Symbol: SLC25A3
  Gene Name: solute carrier family 25 (mitochondrial carrier
  phosphate carrier), member 3
  ENST ID: ENST00000550695
  CDS Start-End: 294-756
ctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagagg

SEQ ID NO: 183441 - DNA, 556 bp, Homo sapiens
  Payload ID: 16140
  Gene Symbol: SLC25A3
  Gene Name: solute carrier family 25 (mitochondrial carrier
  phosphate carrier), member 3
  ENST ID: ENST00000547534
  CDS Start-End: 60-530
ctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggtatgtaattaactttaaaattgaatgttccgagtgtt

SEQ ID NO: 183442 - DNA, 2891 bp, Homo sapiens
  Payload ID: 16141
  Gene Symbol: SLC25A32
  Gene Name: solute carrier family 25 (mitochondrial folate carrier), member 32
  Uniprot ID: Q9H2D1
  ENST ID: ENST00000297578
  CDS Start-End: 168-1115
actagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaa

SEQ ID NO: 183443 - DNA, 2711 bp, Homo sapiens
  Payload ID: 16141
  Gene Symbol: SLC25A32
  Gene Name: solute carrier family 25 (mitochondrial folate carrier), member 32
  ENST ID: ENST00000523256
  CDS Start-End: 235-606
acctcccctccatcgcgctttccgccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaa

SEQ ID NO: 183444 - DNA, 1347 bp, Homo sapiens
  Payload ID: 16141
  Gene Symbol: SLC25A32
  Gene Name: solute carrier family 25 (mitochondrial folate carrier), member 32
  ENST ID: ENST00000523866
  CDS Start-End: 133-504
ataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttgagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcct

SEQ ID NO: 183445 - DNA, 2815 bp, Homo sapiens
  Payload ID: 16141
  Gene Symbol: SLC25A32
  Gene Name: solute carrier family 25 (mitochondrial folate carrier), member 32
  ENST ID: ENST00000521645
  CDS Start-End: 253-702
gactcgggagaggctgggacctcccctccatcgcgctttccgccggcgtgacgtagtgtctgtgccccgttcttgccccctcagtactagagtctccggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctgggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaa

SEQ ID NO: 183446 - DNA, 1451 bp, Homo sapiens
  Payload ID: 16142
  Gene Symbol: SLC25A28
  Gene Name: solute carrier family 25 (mitochondrial iron transporter), member 28
  Uniprot ID: Q96A46
  ENST ID: ENST00000370495
  CDS Start-End: 30-1124
ggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 183447 - DNA, 1005 bp, Homo sapiens
  Payload ID: 16142
  Gene Symbol: SLC25A28
  Gene Name: solute carrier family 25 (mitochondrial iron transporter), member 28
  ENST ID: ENST00000434701
  CDS Start-End: 1-678
cgaggcgctgccggctggagccactgtcaccacgcacatggtggcaggcgccgtggcagggatcctggagcactgcgtgatgtaccccatcgactgcgtcaaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaa

SEQ ID NO: 183448 - DNA, 1889 bp, Homo sapiens
  Payload ID: 16143
  Gene Symbol: SLC25A37
  Gene Name: solute carrier family 25 (mitochondrial iron transporter), member 37
  Uniprot ID: Q9NYZ2
  ENST ID: ENST00000290075
  CDS Start-End: 48-515
ctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtatttttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcattttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagt

SEQ ID NO: 183449 - DNA, 735 bp, Homo sapiens
  Payload ID: 16143
  Gene Symbol: SLC25A37
  Gene Name: solute carrier family 25 (mitochondrial iron transporter), member 37
  ENST ID: ENST00000417331
  CDS Start-End: 48-527
ctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaaca

SEQ ID NO: 183450 - DNA, 823 bp, Homo sapiens
  Payload ID: 16143
  Gene Symbol: SLC25A37
  Gene Name: solute carrier family 25 (mitochondrial iron transporter), member 37
  ENST ID: ENST00000523930
  CDS Start-End: 1-462
gacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaagg

SEQ ID NO: 183451 - DNA, 4823 bp, Homo sapiens
  Payload ID: 16143
  Gene Symbol: SLC25A37
  Gene Name: solute carrier family 25 (mitochondrial iron transporter), member 37
  Uniprot ID: Q9NYZ2
  ENST ID: ENST00000519973
  CDS Start-End: 199-1215
acaccaatggcgcggcggccgccggcctcttggttcccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcattttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgcatccttgtctgctctgcgtcacccgagaacacaggcttcgcagcctcgctttctgaaatggtgtgtgccgagtcagattgccgctcagagaaaatacaagcccgttttccctagctgtgccatttggtgctctgccaggctgccgtgcaagggaataccgacgagacgagctgcactgtctctgatttggagccctcaccggagcttgtctttaaaaatgagcaggaagctcatgtatgtttgcatttcagtgagccgggtcctgacctgccgccacccatcacggtcagcgtggtgcatcttaccgaggaggcgcaggcctggattcttttgagtggtgctactgcctaggaagtaacacgtggagaatttccatcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccactccccaaaaccagttgcagcctcaacccacatggggatgtagaaagccgtaaagtccacgctactgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggattttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgatgaaaccccatctctactaaaaatacaaaaaattagctgggcatggtggcaggcacctgtaatcccagttacttgggaggctgaggcaggagaattgcttgaacccaggaggtggaggttgcagtgagctgagattgtgccactgcacttcagcctgggcgacagagtgactctgtcaaaaaggaaaggcaaaaaccggaccctggagctctgtgggccctgattgcaggcccctccctgtgtgatgagggatgagtcagcttggggagccacttggccagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaacctttgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgaacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcgaa

SEQ ID NO: 183452 - DNA, 2785 bp, Homo sapiens
  Payload ID: 16144
  Gene Symbol: SLC25A21
  Gene Name: solute carrier family 25 (mitochondrial oxoadipate carrier), member 21
  Uniprot ID: Q9BQT8
  ENST ID: ENST00000331299
  CDS Start-End: 517-1416
ttataggacaactaactgaggaatttattcacttgtcccttcttttgaacctcactgtgctctggcttgccaggaggtgcaagtgtcgtccccgctttgtacttggcgctccaggcctgggtcacttcacttgagttatcagaggcaaccgtctagtttgacaaactaccggaggctcctgatagagaagggcgtgggcgccaatctaggagacaaagcctgagccgctgcggtgagccaacccaaacccatccgcgggtcttctttccagagacattttcggagccgagggcgcctctgcgagagcgctgcgaacaggttccgacgcgccggagatcgcgcgacgaatctgcgcctcgaaccctcgctttccagcagtcgccggattgctgctccacagggagccaacgcgcttgaggaccagcccagccggggctctctggatcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtgattgcctatgaagtgtttttcccccttgagataatggatatttgctatgcagcaccatgaagaagagagactatcgatcggccaggtgtataattatgaaggagaaaactgttcaagaacaaaatctattttaatactttaaaaaatgtctataggcaacttgagattatagttttggctgtataaataaaactgtgagaagaaaaaaataatatgaaacaatgaggtatttaaagtgaatatagaaaaatagcatagaaatcatatatttatttcataaaataaatagaaactttgtctcctgtgttcctcttcaatgcttcacaatgaaaattcattgtattgatcagcatttttcctaagaggtctagaaatgcttaaactattgaaaataaatcaaattattcaaagactggattaaaaaaaagttaagccaaaatttaagcagtttttataatgaattaaattattccataaataatatttaaagagcacaagaaaaattttttaaagtgcactaaaatgaccttttaagaatgtttaattttatgaatactatgttaaaatgtaaatctgttggttttttttagtaactatgcacatatcagctctattttcctacatctactttatatctcatattgctgtaagataataaataggtattttaaaacattgtttaaaacagaatgttaaaacactgttgtttaagcatgtttaaatcaaggtattccaaatctcttctaacacaagtaggaaacatgaaataaaatttactttcctccacatagttctctttgaagataagttttgttgatgagatattgtcatgttaaatcacaaattggaaacacctttggacccatttgtcagccatcagtatttgcatccaaatacctttattcagcatgcctacctgtgccatttttaggaagaatgtatagaacagaactgcattttcaggttattagttttaaacgacaacttcaggtgggaagtcagctgtctgcagtattaaaatatgtatgatgaaggggaaatgttctgaaaaagaaatacacttagcatttctaaggattactatactaacatgtatcaacaaaaatatctccttggtcttgatgtaaccaaacttgattttatatctgcatccagagatgatgctgattcagtaaagtcaacaagaataactgaaagtccatatgacacctgtcctaagttactaccgtgggctatttctactacggggctatttcactaaagcattttgaaaataaaaagtaaaagataacatggtaattattactttttattaatttagagcatttgaagtataaaaataaaaggcttttgacatactgtatatacat

SEQ ID NO: 183453 - DNA, 1023 bp, Homo sapiens
  Payload ID: 16144
  Gene Symbol: SLC25A21
  Gene Name: solute carrier family 25 (mitochondrial oxoadipate carrier), member 21
  Uniprot ID: Q9BQT8
  ENST ID: ENST00000555449
  CDS Start-End: 74-970
atcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactgactgggaactccagatgtcaatggaagttttacaagatcaaaggaagactatgg

SEQ ID NO: 183454 - DNA, 3572 bp, Homo sapiens
  Payload ID: 16144
  Gene Symbol: SLC25A21
  Gene Name: solute carrier family 25 (mitochondrial oxoadipate carrier), member 21
  ENST ID: ENST00000622765
  CDS Start-End: 131-835
ttcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtgattgcctatgaagtgtttttcccccttgagataatggatatttgctatgcagcaccatgaagaagagagactatcgatcggccaggtgtataattatgaaggagaaaactgttcaagaacaaaatctattttaatactttaaaaaatgtctataggcaacttgagattatagttttggctgtataaataaaactgtgagaagaaaaaaataatatgaaacaatgaggtatttaaagtgaatatagaaaaatagcatagaaatcatatatttatttcataaaataaatagaaactttgtctcctgtgttcctcttcaatgcttcacaatgaaaattcattgtattgatcagcatttttcctaagaggtctagaaatgcttaaactattgaaaataaatcaaattattcaaagactggattaaaaaaaagttaagccaaaatttaagcagtttttataatgaattaaattattccataaataatatttaaagagcacaagaaaaattttttaaagtgcactaaaatgaccttttaagaatgtttaattttatgaatactatgttaaaatgtaaatctgttggttttttttagtaactatgcacatatcagctctattttcctacatctactttatatctcatattgctgtaagataataaataggtattttaaaacattgtttaaaacagaatgttaaaacactgttgtttaagcatgtttaaatcaaggtattccaaatctcttctaacacaagtaggaaacatgaaataaaatttactttcctccacatagttctctttgaagataagttttgttgatgagatattgtcatgttaaatcacaaattggaaacacctttggacccatttgtcagccatcagtatttgcatccaaatacctttattcagcatgcctacctgtgccatttttaggaagaatgtatagaacagaactgcattttcaggttattagttttaaacgacaacttcaggtgggaagtcagctgtctgcagtattaaaatatgtatgatgaaggggaaatgttctgaaaaagaaatacacttagcatttctaaggattactatactaacatgtatcaacaaaaatatctccttggtcttgatgtaaccaaacttgattttatatctgcatccagagatgatgctgattcagtaaagtcaacaagaataactgaaagtccatatgacacctgtcctaagttactaccgtgggctatttctactacggggctatttcactaaagcattttgaaaataaaaagtaaaagataacatggtaattattactttttattaatttagagcatttgaagtataaaaataaaaggcttttgacatactgtatatacatacatagccttctgttgtacatcctttccaacgtgttttttaaaatttatatttcagtccaatattcaataaaagggtcattaaaaacaaaacaaaattgtgaaaaaaaagaaataagaatgtgtctctgttgcacaactgcattctatccttgcaggtaatattcttacatccaatgagagcgctgcctgcatagaggtcatgaaattgaacctttaacctctccatgtggatcagatagaaaaggatttctgaagagtgcatttgccagtttaaaagcaacacttttaccatctatgagatagaggaaatatgtcaacattaaccaataataatctttaaaagttaaccctttaatccatcctattttccttctcgtattttaaaaagtggctttaaatcataattttctttgaatagcaaattgtatctgatatcttttaaaaattactccatgtgaattcactgttaagacctagagggagaaaaggaaacttcaataccattaatattagattttttaaaatacaagaaccagaaaaaaattataaatagcacaataacaagagatttcttaatttagataaagaaaataacattatttgcatttccacacaagcaagtaatattttttaaagccccctaacagccacctaaaaacatttgataaagaatagttctgtaccttacatcagtttttcagatgacaggagagtccctgtatggtatggttttaaagaagtctccaccaaaatattggattggatctttgttccattcagtttatagtctattttctcaccagactgggaactccagatgtcaatggaagttttacaagatcaaaggaagactatggccctgagagttcatctgctccttctgcttattcttctcctgaagttataatcctctatttgtagcactgaatttcggttgctttagaaataaatgcagttcaaagctctctataagatatctgctgtctgaaaaaagcagtcactctaacataatttgtgtgtcagaaatctgcttactgtttacatcctagtgatttgaaaacctaactaatctagccatctgagttttaaacgaagccacgaaaccgatgtggtggaaccgcattgccatgtagactgtgcacagcacagaccggaagaaattaaaatcacctagggaatccatcttcaacatccatatccagtgaggtgctcttttagttattgcacagaattagtaccaaaaaaccctcaatatattaattttccaacagctgaattgtaccaatgtcctaaaaacatatttttaagcctatattgccaaacaggaagaacttcctaaacagaagggattaaaaactgtagaattt

SEQ ID NO: 183455 - DNA, 1651 bp, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENST ID: ENST00000320362
  CDS Start-End: 231-1193
agtagagttttgctgttaagactgcgcgaggagctagagagagcggagagcgctgagccgggccgcacccgccgagccgtcccttctccctgtgatcagttaccaactacctgttgatgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacac

SEQ ID NO: 183456 - DNA, 1486 bp, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENST ID: ENST00000375261
  CDS Start-End: 225-1016
agtttcgtccgagctcagtagagttttgctgttaagactgcgcgaggagctagagagagcggagagcgctgagccgggccgcacccgccgagccgtcccttctccctgtgatcagttaccaactacctgttgatgtgtgtggttacagacttctttctatgctttgtacaactctacagaccgtatcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaagtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatctt

SEQ ID NO: 183457 - DNA, 2331 bp, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENST ID: ENST00000402418
  CDS Start-End: 911-1873
cacttgagtgggctcactcagtgagcaggagtttgctataaagttgccagatgtcttggaaaaccagttgatctctgggaccaacaattgcctatcaagcctgttcattcgattctcaaatattattaagcacttaccatgatgggctctattccaggaaccggaaatttacgagtgaacaaatgagaccaaggtcgtgtttccacgggcttacattctagtcagggagagagacaagaaacaaatgtactgtataaataacccatggcgtgccgggcgctgtggctcatgcatgtaatctcagcaattcaggaggctgaggcaggagaatcacttgaggccaggagttcgagaccagccagggcaacattgagaccttatctctacaaaaataaaaaacttagccaggcctgcacctgttaagtgacagctaattgggaggctgaggcaagagaatcacttgagcccaggagttcaaggctatggtgagttatgatggcaccactgcattccagcctgggcaacagagtgagaccctgtctctaaaaaagtaaacaaatatgccatagtaataagtactgtaaagaggaataaaacaagtgctattttattttatttttaaatttttgtattttttgtagagttggggttttgcagtgttgcccaggctggtcttgaactcctgagctcaagcaatccacccacctcggcctccgaaagtgctgggatacaggcatgaaccgctgcgcccagtccaaaagtgagtgctattttagacagtctagtcagggagggctgctctgaggaggtgatatttgagcagagaccataagaaacttgcctggtgtttattccgtatctcttgcatttagcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacac

SEQ ID NO: 183458 - DNA, 1587 bp, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENST ID: ENST00000416858
  CDS Start-End: 166-1128
cggagagcgctgagccgggccgcacccgccgagccgtcccttctccctgtgatcagttaccaactacctgttgatgtgtgtggttacagacttctttctatgctttgtacaactctacagaccgtatcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacaca

SEQ ID NO: 183459 - DNA, 1496 bp, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENST ID: ENST00000442286
  CDS Start-End: 76-1038
cggagagcgctgagccgggccgcacccgccgagccgtcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacac

SEQ ID NO: 183460 - DNA, 693 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000583332
  CDS Start-End: 146-693
gagcgctgagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtacggagatacaagggcctcatggactgtgccaagcaggtgctgcaaaaggaaggcgccctgggcttcttcaagggcctgtcccccag

SEQ ID NO: 183461 - DNA, 748 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000580151
  CDS Start-End: 296-748
gaggagctagagagagcggagagcgctgagccgggccgcacccgccgagccgtcccttctccctgtgatcagttaccaactacctgttgatgtgtgtggttacagacttctttctatgctttgtacaactctacagaccgtatgtaggtattactgtttttgttttttgtttttacaaaaaaggaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgag

SEQ ID NO: 183462 - DNA, 448 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000582822
  CDS Start-End: 1-202
caagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacaca

SEQ ID NO: 183463 - DNA, 513 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000582778
  CDS Start-End: 257-513
agagaagcatctccagggacaccggcggccgagccccgcgcacgcccttgagcacctgagctccagggcgtcccctcggactcaaggagaaaaaacacaccccgaggcacacgtggacacctagcccttctccctgtgatcagttaccaactacctgttgatgtgtgtggttacagacttctttctatgctttgtacaactctacagaccgtatgtagcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctca

SEQ ID NO: 183464 - DNA, 582 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000580273
  CDS Start-End: 329-582
gcacaaccattggtccagcgtctggcggggagctgcacggtgattggcccaggagcccgccagtttcgtccgagctcagtagagttttgctgttaagactgcgcgaggagctagagagagcggagagcgctgagccgggccgcacccgccgagccgtcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatctt

SEQ ID NO: 183465 - DNA, 717 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000581988
  CDS Start-End: 401-717
gagccgtgtgagtaacctctacctccgtccttctcgccgccctctcggggaccagcaccctcgctcctcagggtggtcgggagggagcacacgcacccgggcgctcacgagagggcggggactgtgtacacacgtgtcacaccagaccagagaagcatctccagggacaccggcggccgagccccgcgcacgcccttgagcacctgagctccagggcgtcccctcggactcaaggagaaaaaacacaccccgaggcacacgtggacacctagcccttctccctgtgatcagttaccaactacctgttgatgtgtgtggttacagacttctttctatgctttgtacaactctacagaccgtatcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagct

SEQ ID NO: 183466 - DNA, 855 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000579207
  CDS Start-End: 397-855
gccgcacccgccgagccgtgtgagtaacctctacctccgtccttctcgccgccctctcggggaccagcaccctcgctcctcagggtggtcgggagggagcacacgcacccgggcgctcacgagagggcggggactgtgtacacacgtgtcacaccagaccagagaagcatctccagggacaccggcggccgagccccgcgcacgcccttgagcacctgagctccagggcgtcccctcggactcaaggagaaaaaacacaccccgaggcacacgtggacacctaggaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaag

SEQ ID NO: 183467 - DNA, 1554 bp, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENST ID: ENST00000580994
  CDS Start-End: 171-1133
tgcgcgaggagctagagagagcggagagcgctgagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtatgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagtgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgttt

SEQ ID NO: 183468 - DNA, 569 bp, Homo sapiens
  Payload ID: 16145
  Gene Symbol: SLC25A19
  Gene Name: solute carrier family 25 (mitochondrial thiamine pyrophosphate carrier), member 19
  ENST ID: ENST00000584438
  CDS Start-End: 452-569
gctgttaagactgcgcgaggagctagagagagcggagagcgctgagccgggccgcacccgccgagccgtgtgagtaacctctacctccgtccttctcgccgccctctcggggaccagcaccctcgctcctcagggtggtcgggagggagcacacgcacccgggcgctcacgagagggcggggactgtgtacacacgtgtcacaccagaccagagaagcatctccagggacaccggcggccgagccccgcgcacgcccttgagcacctgagctccagggcgtcccctcggactcaaggagaaaaaacacaccccgaggcacacgtggacacctaggtacccacacggggacctctgcagatttgctcagctgagcccttgggcacatgggcacccgaacaccaggaagagcctgcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatca

SEQ ID NO: 183469 - DNA, 3854 bp, Homo sapiens
  Payload ID: 16146
  Gene Symbol: SLC25A33
  Gene Name: solute carrier family 25 (pyrimidine nucleotide carrier), member 33
  Uniprot ID: Q9BSK2
  ENST ID: ENST00000302692
  CDS Start-End: 211-1176
gcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtatacatttggcttgtgtcctcttttatgctcactatactatgaaggacttaagtaattcagataaacctgccctagaactgcagagaaaaatgataaagtgagaatacaacttgttttataatctgactttaagatcttgcactgctagacagggaagaagtgtcgcattttggctgggcactgtggctcacgcccgtaatcccagcactttgggaggccgaggcagatggatcacgtgaagtcaggagttccagaccagcctggccaacatggcgaaaccctgtctctactaaaaatacaaaaattagccggacgtgtgcctgtaatcccagctacttgggaggctgaggcaggagaatcacttgaaacccagggggcagaggttgcagcgagctgagatcacgtcacttcactccagcctggtcgacagagtgagactccatctcaaaaaaaaaaaaattgtgtcacattttggtggtggtgtgtggaccaggacaaacttcccagcaatttttcttctttgtacatttccaattacttgcagattgatcatctaagcgttcagactgctgagatgaatatatataactttctgagactcaatattttaagctataaaaaacttcctgaagttatccttttctccctactttgaaccaaaggcaagaatttttaaagaactgttttatcaatggcctggctcctggatatagttccggaagttaagaccagttgccttgttaagtgtgttgacagcacagctaccctgtttggctgtgaatccagaatgtgatgaagaacagtcattcccactgaggtctttagccctgttcttggacctctgctcttgcagaaaaggagcacaacgtaggactatggctcacccgtcagagagctcacattctgatagaaagcactgggattgtttaaatatcctagttcaacattaaaaaaaaaaaaaatttaatcccagcactttgggaggccaaggcgggcagatcacgaggtcaggagatcgagaccatcctggctaacacggtgaaaccccgtctctactaaaaaaatacaaaaaaattggccatgcgtggtggcgggcacccatagtcccagctactcgggaggctgaggcaggagaatggcgtgaacctgggaggcggagcttgcagtgagctgagatggcgccactgcactccagcctgggccacagagtgcgactccatctcaaaaaaaaaaaaaaaaccaggatgttacccccttggttttaaagcaaatttaataagggaacaaaaagatgatactaagaagaaggcaagtaaaacccctagtcttccattagctctttcactggaatttgagtatattgtacatgaaggttggttttcaatttgaacgtctagaaagatactcatttctaatacctatgcactgtagtttcaggtttacttgcagacaccctggtagggttaagaggaggatatttccaagttattttaaattgagtttacttttaactggggttcttgactctagtgtaattgctccaacaactacgtagaagtcaaaatgagtgactttagtgaagcttctgtactttacaatacatgacagtaatgctattccagaagttttgttttgttttgttttgagatggagtctcgctctgtctctcccaggctggagtgcagtggcacaatctcggctcactacagcctccacctcccggtttcaagcaattctcctgtcttagcctcctgagtagctgggactacaggcatgcgccaccacacctggctaattttgtatttttagtagagatggggtttcaccatgttggccaggctggtctcaaactcttgacctcaggtgatctacccgcctcggcctcccaaagtactgggattacaggagggagccaccatacctggcccgcgccgccccttcctttgttgttattgttgttttgagacaaggtatcactcgatcactgaagctggatacagtggcaagatcatagctcactgtaacctcaaactcctgggcacaagggatcctcgcatctcagcctcccaagtagcttggaccacaggaaagtaccaccatgcccagctaatgttttttcattttttgtgcagacgaggttttgctatgttgtccaggctggtctcagactactggccagaagcgatcttacctcctcagcctcccaaagcactggaattacagagtaacatctaattttaatattcacattcctattttaatattcatattcgatgatggcacttagcaacatcctcctatatccatattaaaacctgttttccaagattgtgtctaatatgaaggtgtaaaattgctttgttttcactccttcttgaatgaataaatttgatagtaaccaattataa

SEQ ID NO: 183470 - DNA, 1301 bp, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENST ID: ENST00000324194
  CDS Start-End: 169-1104
gccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaa

SEQ ID NO: 183471 - DNA, 1040 bp, Homo sapiens
  Payload ID: 16147
  Gene Symbol: SLC25A36
  Gene Name: solute carrier family 25 (pyrimidine nucleotide carrier), member 36
  ENST ID: ENST00000453248
  CDS Start-End: 155-1012
tgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaa

SEQ ID NO: 183472 - DNA, 4638 bp, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENST ID: ENST00000446041
  CDS Start-End: 226-1158
gctttcagcctctggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctttttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcacgtattaggcagaaacagtgttcataacatttttctgggttttaaatatgttgtttcggatatccttaatataaatgttttaggtattctgtgtaccctgtcgtacccccaacattatagaatattgcagcgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaatcgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaccaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgccttttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctca

SEQ ID NO: 183473 - DNA, 3537 bp, Homo sapiens
  Payload ID: 16147
  Gene Symbol: SLC25A36
  Gene Name: solute carrier family 25 (pyrimidine nucleotide carrier), member 36
  ENST ID: ENST00000507429
  CDS Start-End: 169-567
gccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggtatgaatgtataatattaaaaaaaaaaaaaactttctgaaacctagaggcttaatattgaattataagtttgtagtgaaaagttgatgattaatgtgcttttcattgattagatgatttttacgtttatcgatataaaccaaattaggtatatgtaaaatctgtcatcagttgacatttttgtagtcaggagtttacatgctagggtacaagtaatatatttatattgccttgtgtagtccactgaatgtttagtgatcattgttaacagttttaagaatccaaccataattacactataaataagttatggagctgtaatttactcttctctcctcaatttctgttagtgccttttccctttttgctgcatgttttggcttctgtctgaaatgtgtcggcaattcttggtaaagtattcattttgtcctgtgctcaaatgctgaaatttttgtgagtgatgtattattattgacaattcagttactatgtgtattttttaaaattgtttattattctacataattcacactagacagcacctgaaatttagacactggctatgtgtacatgcttactatagaaatgtttccaggaactctctgtttctgtcatcactgataagtatatatgattctgaattaaaataactagttttaggtctttaccctgccataaagataaacagttggtttgaccaatctggttctggaatcatttgctgctatgcatgttagacaaagccacgaactttgattttccattgaaaattctccctaatatctgagatttattgtatatttactcatatctcacattttcaaattatgctgtaactttataaactgtagctgctttcatcagctattgatcaataaattgaatgtcaattatgtgcttaataatgagtgccttaaactgttaaacacttttggtttagaaataaagtgaatcaatttgacctatatacttcatgaagtaagtaagtttgaaatacaaatttctgaaaggtcaatagcccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaactagaattatttttaatgtaatttttacagatgttgaatattagtagataggatttttcccctacgaatttggatgtaaggtaaaggttggtggccagtgacaaaccttataaccactttatcaggttctttaaaaatatatttctgaattaccagtgattatgtttttggcttataacctcagataattataaagaaatgttaatcttatttgaaagaattggaatctagaaagttagatgagcagtcattttatattgatatttgttatatcagtatagcaaatgcagaggttcagaatatctttatttccactggaacatcttatttcattggagtatctcatcagaatttattactgtatttgtatcacattgcaaagaatttcagtagaattgtcagtttgcacttttttctcaaatgtgtacaaatgttaacatatagttcatttttatctgtacattgatgccatttcccaacttgaattcctcaagttttggtaaacttacaatctcatacttgttcagaggttattgcactgtacacttactgtgtagaaaatactgtttgaatttgtttgcagttacattgttctgagaactgtgctctcagagcttctgtgcactattcatgagcattaacacttagctttgcagttttatacataactatatggttagtaaaactgaatggtccaatgcagactcattaaagtaggcttttgccccctttgttcttgaaataatctagaccagattactcggggttttttttaggattatttttataggtctaaatatgaatgatttgggggtatgaagtacttaaagatagttctgtgaaaaatcattttcagctgtctattcaagggaaaaaatgctaaccttgtcactttactacacaaaaccacactaaaataaaccattaatgatactgcctgcaagattttaacacaccagatagcacacacattaaggatttataaggcactgtacgtaatttttattccaagtgacctctcaattcattttcattttgcattttatccatatgaactcatgtttaatttagataataaaaatttattttattaaaaggacagtttatttaaagtgggtctttttatttgttgtagtgcatactataagaatttgtaagcctctaaagttgagctataaattttcatgcattaaaaatttgtttcagttgtgaggatatttaatcagattaaataatgttgactcttaatattttgcctgccttttttttctcctacacatgacctttgacagactaagtatatctcagctattgagggtatctgttttgttgcctgtatattttgtttaaattaacttgtatattcctttgtatacacctaggcacagatgtatgcaaaaaaaatttgttaaattacttctttctttatactaattctcaatttttaaaagattttatctggcatgtatatacttttatatagaacattataaatgtaaaggaaatgaattctaattttaattggattatgtattcatacagttattctcaatttttaaaatactaataatgtaatcattgaatgtttcctacatacgtagtgggttttatttgctcacagcatacagttatttttcaatttatgtttttctattagacttaaatttcattataataaaggcttttactcattaaataca

SEQ ID NO: 183474 - DNA, 578 bp, Homo sapiens
  Payload ID: 16147
  Gene Symbol: SLC25A36
  Gene Name: solute carrier family 25 (pyrimidine nucleotide carrier), member 36
  ENST ID: ENST00000513887
  CDS Start-End: 378-578
tgattacccggacgccgctggacctggccgcacgccgcaatctagcaggcgtcggggatccagggccgctttgaggagcctggcttcggatttcgcgtaggttgcatggcccaaggggacggggcggaaagtgcggaggctgaggacaaaatgggcgccggagactcctttagccctcgctccttgcagcgctcgcttgggcctctgcacgtcactcacgccccacctcggacctcgggccgctcatttccgggctcggctttgcaagatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaag

SEQ ID NO: 183475 - DNA, 1163 bp, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENST ID: ENST00000502594
  CDS Start-End: 161-559
gagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggtcacttcctgtagaaatatggactaacttaaacctcgttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaa

SEQ ID NO: 183476 - DNA, 727 bp, Homo sapiens
  Payload ID: 16147
  Gene Symbol: SLC25A36
  Gene Name: solute carrier family 25 (pyrimidine nucleotide carrier), member 36
  ENST ID: ENST00000512506
  CDS Start-End: 10-279
ctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggcatttactgtacatttctcccgagaaaagagtgagatcgtgtcatctcatgctccccatccgcaggtcacttcctgtagaaatatggactaacttaaacctcgttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgt

SEQ ID NO: 183477 - DNA, 817 bp, Homo sapiens
  Payload ID: 16147
  Gene Symbol: SLC25A36
  Gene Name: solute carrier family 25 (pyrimidine nucleotide carrier), member 36
  ENST ID: ENST00000512023
  CDS Start-End: 112-372
agatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcagaacacaagaaattaaatacaaaataatgcaaaatatttcataagtatggatgtgcaatattactggccatagtgcaaaaggtgaaaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaag

SEQ ID NO: 183478 - DNA, 620 bp, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENST ID: ENST00000631654
  CDS Start-End: 62-460
ccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggtcacttcctgtagaaatatggactaacttaaacctccctcaaattcttttgtgacttggaagagtattatggacagaagcttgggttttactgcaatcacagcaaccaaccccatttggcttataaagactcggttacagcttgatgcaaggaaccgcggggaaaggcgaatg

SEQ ID NO: 183479 - DNA, 1023 bp, Homo sapiens
  Payload ID: 16148
  Gene Symbol: SLC25A26
  Gene Name: solute carrier family 25 (S-adenosylmethionine carrier), member 26
  Uniprot ID: Q70HW3
  ENST ID: ENST00000336733
  CDS Start-End: 191-751
aaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctg

SEQ ID NO: 183480 - DNA, 2673 bp, Homo sapiens
  Payload ID: 16148
  Gene Symbol: SLC25A26
  Gene Name: solute carrier family 25 (S-adenosylmethionine carrier), member 26
  ENST ID: ENST00000354883
  CDS Start-End: 729-1553
aacctgaagctctcagagcttccctgtcttcatctatcagcccagggagaggaatcagtggttttccaaaagctgtacctctttccataaatacaaggatgaagggctgagatgatggcagttagaattatattgagaaatggtagcgggatctgagaaagcaaggccatgagttgaaagcagagagaaggcggttcgagtggagccctgatgaagttcatgctcatggttgcccagccattaacacgggctcatcacatctgtttccagattgcttctagaacttagctaccctcgttctataagatggaatgaaaatgcgtactacatacagatcatgaaaagacgcaaagaaaatgcatcttcacattgcagttcagaatcacgccggcctcattctaccgctgctctctcctggatctcggccacggatcttttgctcgcgaaagttcctccgtctagctgcacacaacgctgctgcaggaaaccgaggtaagggatttgccgagacttagctccaccacactccccgaggccccgcccctcctctctggccctcccctaggcccaggtgtctcgcgttgcacgtgcagttgttgtggttctacgtcacgtggtcccggaagttcaagacagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagtaa

SEQ ID NO: 183481 - DNA, 1096 bp, Homo sapiens
  Payload ID: 16148
  Gene Symbol: SLC25A26
  Gene Name: solute carrier family 25 (S-adenosylmethionine carrier), member 26
  ENST ID: ENST00000413054
  CDS Start-End: 75-707
ctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggggaccatataccagggattttcttgcaagagcaaagcagtggcctccctttgcagagggtcggtcggcagctgcctggacttcgggcgtctcagctggcagtgccacctcctcatcctgatgccgagttggatcacttatgtgattgtagtttttgtgtacctttggcagttttaatctcagctatttgatgatctggaggacatgaagtagattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctctt

SEQ ID NO: 183482 - DNA, 3879 bp, Homo sapiens
  Payload ID: 16148
  Gene Symbol: SLC25A26
  Gene Name: solute carrier family 25 (S-adenosylmethionine carrier), member 26
  ENST ID: ENST00000464350
  CDS Start-End: 139-399
ggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaaggttggaagccatataactgcttttgaatagagcagctaaagaagtcccaagttgccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttgagatgtgtccagcgccccctgtggtgtgtgagagaaagcagctgcaactcaagtgactaggtgggcccagctggcttcgtgcaggagggcacgatccaagtcctgtgagcgactgatactccacatgggagttacaactatgtacagatgagtgacgcttgaacccaagcttcctcgcagcctctcctacctctctttcccgtagagattggtatgacaagaactgaggtagacaaaacctagctttttggtgccaacagcagtggcaccctctgtttcccggggagctgtcctgtcagtggcgtggactcgggactggcgtcacatgctttggggaggtggccattggaaacaagcaagtactgggcttccgcgcgctctggactgcctgaagttaatgaagatgcaggctgtagctctgtggagtccgggtgatacaaccttgctaaagtccaggaagaatcccctacaaggaaagaacgaacctgtcagacccccacttgaccgtttaagcagctcccaacccacctgttagaagacagtcaaaagttacctttcccatctagagatgccattggctttttcttcacagccgtcagcattctatcgtggttactggggtagagcgacccttggcactcggggcaggacccagcggcagtcctgctgcactggtgatgtggagaatgctcttggtcactcccacccggctccgggccatttggcgcacttggctgtgcgctgtctctggacacaggctgggggtggaaggcttgtcccctggagtaacagtccacttcggtgttgcagtcactgcatacgacccggccaccgtgttctgaaggacagcgccaaagatgggttagagtcactgctgtgggagtcttcgtccccacacagaggacaggctgctcagctccactgtgcaaggcaaaggtcatgggggagctgctgctgctggctgctgagcatgtaaaccggatgtccttgcccaccatagccatggtggtttctggctgggtgatgatctgtggcttcaggaagtcatctggggagagaagggtcaactgtaaagcgctgggttcttggtacacagaggaaccagctgctgttcatgctaacagaaactgacacagacaccaagcaggaaccagagcttgaggtccctgtgcatcctcagccccaccaaccagatgccgtaagagttgcaccatggacatctgacctcatctaattagaagtctgtgagtactgatcacctttatgatcacactccttgattagaaattaacccaccacttctcagttctcaaaccagccagccggcagtttccttaagacaactggctctgcctgctgactttcacacaaaacagtcaggcaccactggtcatgactgcagagatcttacccacaaaccttactccaaaaggagggggtgtaaaacacttccaaaatgtcagaataaggacctccaaaaatctgcacctccattaaaacaaggaaaacacctggaaaaatggtcaaaagcaactttttcagaattctggaaaaccaaaggcttacaacaatccatggattgttgattcaagcaaatagcaacatctcagaaatgtgagctttgtggtattttaacttatccaaagccccattcttccctccccagctccatggtagccttgaaacccagcagcctagcaaccactcaagggtcagaatgggctccccaaaagccccatcctcagaactgacaccatgtggcctatctggcagcaacacggaaagccccattcacaggatttgcattgatttgccctgatctagtttgccgagcaggagaagccctagccccagggcacatgactacaacaatcagtagccactgttcaacagcgcagctgtctgaggggacaatacccatggggcaaacaagcagctggccaaaaaactataaaggaaaatgtggggaatacagtgttaatggtgggctttgaaaaggtccaatacattcctggggatctagacagccacatgcaggtgcaaggccatgtgcacacccaggaaagacgtgagggggtcctcatttgtcacctgtggctgagcatgactgtctacacaaataggaagtgatggcacaccccaacacaaacacacaagccgtcggtaaaggataggagacagtggttgtggtgacttctctgtccaaccattagctaaccactaaactaaacaagcagggacttaaggggacggactttatatagcctttgtccaggaaaagtcactaggcaagctgtaacaataaacagcaacagcagcaaatcctgggggaggagaaagggaatatccaatttccagagttgccacattattttattttaaatgcccaattttcaacaaaatattatgaaacactcaaacaggaaaaaaagcagtcaacagaaactgtctctgagggagcccagacttagattcactaaataaactttttaaatcggcaattataggcatattcaaacacctcaaggaaaccatgtcttaaaaaaaatatcgaaggatagtggccaggtggggtggctcacgcctataatcccagcactttgggaggctgaggcaggaggatcatgaggtcaggagatcaagaccatcctggctaacatggggaaaccctgtctctactaaaaatacaaaaaaaaaaaaaaaattagccgggtgtggtggcaggtgcctgtagtcccagctactagggaggccgaggcaggagaatggcatgaacccaggaggcggagcttgcagtgagccaagatcacgccactgccctccagcctgggtgacagagcaagactctgtctcaaaaaaaaaa

SEQ ID NO: 183483 - DNA, 1840 bp, Homo sapiens
  Payload ID: 16148
  Gene Symbol: SLC25A26
  Gene Name: solute carrier family 25 (S-adenosylmethionine carrier), member 26
  ENST ID: ENST00000483224
  CDS Start-End: 1-275
ctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagaggaggaggattagagtcaaaggtgtggggaggcttgtgagcttctgtgagttgttgtgtgtggcttgtatacatgctgttatactgattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagtaa

SEQ ID NO: 183484 - DNA, 3879 bp, Homo sapiens; identical to SEQ ID NO: 183482
  Payload ID: 16148
  Gene Symbol: SLC25A26
  Gene Name: Solute carrier family 25 (S-adenosylmethionine carrier), member 26
  ENST ID: ENST00000634032
  CDS Start-End: 139-399

SEQ ID NO: 183485 - DNA, 1840 bp, Homo sapiens; identical to SEQ ID NO: 183483
  Payload ID: 16148
  Gene Symbol: SLC25A26
  Gene Name: Solute carrier family 25 (S-adenosylmethionine carrier), member 26
  ENST ID: ENST00000632740
  CDS Start-End: 1-275

SEQ ID NO: 183486 - DNA, 1096 bp, Homo sapiens; identical to SEQ ID NO: 183481
  Payload ID: 16148
  Gene Symbol: SLC25A26
  Gene Name: Solute carrier family 25 (S-adenosylmethionine carrier), member 26
  ENST ID: ENST00000633238
  CDS Start-End: 75-707

SEQ ID NO: 183487 - DNA, 2673 bp, Homo sapiens; identical to SEQ ID NO: 183480
  Payload ID: 16148
  Gene Symbol: SLC25A26
  Gene Name: Solute carrier family 25 (S-adenosylmethionine carrier), member 26
  ENST ID: ENST00000633701
  CDS Start-End: 729-1553

SEQ ID NO: 183488 - DNA, 1023 bp, Homo sapiens; identical to SEQ ID NO: 183479
  Payload ID: 16148
  Gene Symbol: SLC25A26
  Gene Name: Solute carrier family 25 (S-adenosylmethionine carrier), member 26
  ENST ID: ENST00000632575
  CDS Start-End: 191-751

SEQ ID NO: 183489 - DNA, 2963 bp, Homo sapiens
  Payload ID: 16149
  Gene Symbol: SLC25A27
  Gene Name: solute carrier family 25, member 27
  Uniprot ID: O95847
  ENST ID: ENST00000371347
  CDS Start-End: 253-1224
gactacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttcctctgacagccacacaccgaatcttgatgaaaaaagagaagagcatttgccttgttacatagtctgttacaagccagatatgttgctagctctcaagagttgtaatatattaagaactacaacttatttgattaaaactcagctgtatagatccttttataaagcaccttttgttaaacatcagcctttcattggtattttaaaagcaaggcagatagatatgaagtcagccaactctgacatgcgtcctttcttatctcccttacctgacactaggggctctagagaggcagagagagcactcacaaatcacactaaaactgccagcggcctgactcttactcagtttagcaaaaattcttgcctaaaaagtgataagtaaaaatctgtttatggtatacagttatgtctcgaatctttgaatcaaatccatgttcttattttagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaacaa

SEQ ID NO: 183490 - DNA, 2526 bp, Homo sapiens
  Payload ID: 16149
  Gene Symbol: SLC25A27
  Gene Name: solute carrier family 25, member 27
  Uniprot ID: O95847
  ENST ID: ENST00000411689
  CDS Start-End: 279-1016
aatcagagacgtagcggagcccggcggactacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttcctctgacagccacacaccgaatcttgatgaaaaaagagaagagcatttgccttgttacatagtctgttacaagccagatatgttgctagctctcaagagttgtaatatattaagaactacaacttatttgattaaaactcagctgtatagatccttttataaagcaccttttgttaaacatcagcctttcattggtattttaaaagcaaggcagatagatatgaagtcagccaactctgacatgcgtcctttcttatctcccttacctgacactaggggctctagagaggcagagagagcactcacaaatcacactaaaactgccagcggcctgactcttactcagtttagcaaaaattcttgcctaaaaagtgataagtaaaaatctgtttatggtatacagttatgtctcgaatctttgaatcaaatccatgttcttattttagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaa

SEQ ID NO: 183491 - DNA, 650 bp, Homo sapiens
  Payload ID: 16149
  Gene Symbol: SLC25A27
  Gene Name: solute carrier family 25, member 27
  ENST ID: ENST00000604616
  CDS Start-End: 1-296
tgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttc

SEQ ID NO: 183492 - DNA, 433 bp, Homo sapiens
  Payload ID: 16149
  Gene Symbol: SLC25A27
  Gene Name: solute carrier family 25, member 27
  ENST ID: ENST00000604217
  CDS Start-End: 1-433
aatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatg

SEQ ID NO: 183493 - DNA, 659 bp, Homo sapiens
  Payload ID: 16149
  Gene Symbol: SLC25A27
  Gene Name: solute carrier family 25, member 27
  ENST ID: ENST00000603486
  CDS Start-End: 212-659
ctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtat

SEQ ID NO: 183494 - DNA, 837 bp, Homo sapiens
  Payload ID: 16149
  Gene Symbol: SLC25A27
  Gene Name: solute carrier family 25, member 27
  ENST ID: ENST00000604127
  CDS Start-End: 1-436
aatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgtgatctggtcggatctcacaaggccatccaatgagaccccgcacagcattttctaaagaagaatcgaagcctgaccactttcaccttgggcaagaagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatg

SEQ ID NO: 183495 - DNA, 1094 bp, Homo sapiens
  Payload ID: 16150
  Gene Symbol: SLC25A30
  Gene Name: solute carrier family 25, member 30
  ENST ID: ENST00000310862
  CDS Start-End: 341-454
ttttccttttctccagcggcctcaggttcttgttacaactgagtccgggttggaggaggtgtggggccgctgccgccagggtgttactgtgttgcccaggctggtcttgaaatcctgggttgaaacaattctcctaccttggcctctcaaaatgctgggattacaggcgtgagccatcatggctgctgcaaatacttattgcatgaagaatagatttaagataaaatagacttcccagagaacagcttccgctgcactacactgaatacatacacgcataccaaggaaaaacagcactggaggcaatgtttctataaatcaaagaagagacagtgtgagaatgtcagccctcaactggaagccgtttgtgtacggggggctggcctccatcactgctgagtgcggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctt

SEQ ID NO: 183496 - DNA, 426 bp, Homo sapiens
  Payload ID: 16150
  Gene Symbol: SLC25A30
  Gene Name: solute carrier family 25, member 30
  ENST ID: ENST00000463262
  CDS Start-End: 137-250
ttttttccttttctccagcggcctcaggttcttgttacaactgagtccgggttggaggaggtgtggggccgctgccgccaggaaaaacagcactggaggcaatgtttctataaatcaaagaagagacagtgtgagaatgtcagccctcaactggaagccgtttgtgtacggggggctggcctccatcactgctgagtgcggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgata

SEQ ID NO: 183497 - DNA, 3670 bp, Homo sapiens
  Payload ID: 16150
  Gene Symbol: SLC25A30
  Gene Name: solute carrier family 25, member 30
  Uniprot ID: Q5SVS4
  ENST ID: ENST00000519676
  CDS Start-End: 137-1012
ttttttccttttctccagcggcctcaggttcttgttacaactgagtccgggttggaggaggtgtggggccgctgccgccaggaaaaacagcactggaggcaatgtttctataaatcaaagaagagacagtgtgagaatgtcagccctcaactggaagccgtttgtgtacggggggctggcctccatcactgctgagtgcggtacatttccaattgatttaaccaagacacggctccagattcaaggccagacgaatgatgcaaaatttaaggaaattagataccgaggaatgttgcacgcattagtgaggataggcagagaagaagggctgaaagcactctactcggggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgaaggttgcaaggtctgtattggtggggggtgttttcaagcagcttaggttctgtcttaggtcatgttagtaattagctttatgatttttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacagctctaaacagtctatgtagaagaggggcatgttctcatgggcttctcatggtaattgtgaatgaagccctttgttaaggtcttgttgaagaaagaacactgtataagttcaggctttagtacattttccttagcaaaatgttggtagtgaatcaaagagttgatttttccaggtttccagtttttactttagtttatgttgtgcctgtcttggactttctgtttagtttggatggaaaatacctgcttgaaattttaaaaatgatttctttagtgcatctatttagctagtttctgataggtggtatgtaatattttccctttttctttccttctgtagacacaataagtcattctccctcttctttttttctttttctattttcttattctttactctaacctgcttcagagaaagagccctcttccttcttgtcttcatcttagtcttttcaaaataaaagatgactgtgagaaccccaagaacttccacttctgggaggcagccacaggacagggaacatatttatttgggtctcttcagttccccctttgagaacaacattaaatacatgttagctggggctccagggcattctccttccacagtagtgcggccaaattcccagtctggccagtctctttgttgagactgaatagaaggactgcaggtttttttggaggatgagataatttttcctcgcaggcatttttcccttgccttccttatgcatgaatggtccctttgaatattatttccaaaagtgagagctaagacaaagtcatcaaaaagagaggataacagaaggtgggggcgggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaa

SEQ ID NO: 183498 - DNA, 582 bp, Homo sapiens
  Payload ID: 16150
  Gene Symbol: SLC25A30
  Gene Name: solute carrier family 25, member 30
  ENST ID: ENST00000519547
  CDS Start-End: 171-582
ttttttccttttctccagcggcctcaggttcttgttacaactgagtccgggttggaggaggtgtggggccgctgccgccaggtacatttccaattgatttaaccaagacacggctccagattcaaggccagacgaatgatgcaaaatttaaggaaattagataccgaggaatgttgcacgcattagtgaggataggcagagaagaagggctgaaagcactctactcggggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagc

SEQ ID NO: 183499 - DNA, 453 bp, Homo sapiens
  Payload ID: 16150
  Gene Symbol: SLC25A30
  Gene Name: solute carrier family 25, member 30
  ENST ID: ENST00000522438
  CDS Start-End: 170-453
gcgtgtttgcgcggacggggcggggcggcgcggggctgcgtgcaggctcgtgggtctgccccgcccgcgacggcattttttccttttctccagcggcctcaggttcttgttacaactgagtccgggttggaggaggtgtggggccgctgccgccaggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgca

SEQ ID NO: 183500 - DNA, 3608 bp, Homo sapiens
  Payload ID: 16150
  Gene Symbol: SLC25A30
  Gene Name: solute carrier family 25, member 30
  Uniprot ID: Q5SVS4
  ENST ID: ENST00000539591
  CDS Start-End: 246-968
gcgtgtttgcgcggacggggcggggcggcgcggggctgcgtgcaggctcgtgggtctgccccgcccgcgacggcattttttccttttctccagcggcctcaggttcttgttacaactgagtccgggttggaggaggtgtggggccgctgccgccaggtacatttccaattgatttaaccaagacacggctccagattcaaggccagacgaatgatgcaaaatttaaggaaattagataccgaggaatgttgcacgcattagtgaggataggcagagaagaagggctgaaagcactctactcggggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgaaggttgcaaggtctgtattggtggggggtgttttcaagcagcttaggttctgtcttaggtcatgttagtaattagctttatgatttttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacagctctaaacagtctatgtagaagaggggcatgttctcatgggcttctcatggtaattgtgaatgaagccctttgttaaggtcttgttgaagaaagaacactgtataagttcaggctttagtacattttccttagcaaaatgttggtagtgaatcaaagagttgatttttccaggtttccagtttttactttagtttatgttgtgcctgtcttggactttctgtttagtttggatggaaaatacctgcttgaaattttaaaaatgatttctttagtgcatctatttagctagtttctgataggtggtatgtaatattttccctttttctttccttctgtagacacaataagtcattctccctcttctttttttctttttctattttcttattctttactctaacctgcttcagagaaagagccctcttccttcttgtcttcatcttagtcttttcaaaataaaagatgactgtgagaaccccaagaacttccacttctgggaggcagccacaggacagggaacatatttatttgggtctcttcagttccccctttgagaacaacattaaatacatgttagctggggctccagggcattctccttccacagtagtgcggccaaattcccagtctggccagtctctttgttgagactgaatagaaggactgcaggtttttttggaggatgagataatttttcctcgcaggcatttttcccttgccttccttatgcatgaatggtccctttgaatattatttccaaaagtgagagctaagacaaagtcatcaaaaagagaggataacagaaggtgggggcgggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagt

SEQ ID NO: 183501 - DNA, 525 bp, Homo sapiens
  Payload ID: 16150
  Gene Symbol: SLC25A30
  Gene Name: solute carrier family 25, member 30
  ENST ID: ENST00000618165
  CDS Start-End: 1-359
cgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacaggtgttgccttaatgaagcaaagacacttatcgtattcatccacctgacatcttgggaaatagtggtactctgaatgatatctctaccactattgcttctttatttgtgacctgttcaggagcccacatggcacggaagcaacagaccgtaattggaattaaatctaattttttcctca

SEQ ID NO: 183502 - DNA, 2986 bp, Homo sapiens
  Payload ID: 16151
  Gene Symbol: SLC25A34
  Gene Name: solute carrier family 25, member 34
  Uniprot ID: Q6PIV7
  ENST ID: ENST00000294454
  CDS Start-End: 82-996
tacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgtcgctgctgtggcccgagcagacgggctgtggggcctgcagaaggggctggctgccggccttctgtaccaaggcctcatgaatggcgttcgtttctactgctacagcctggcgtgccaggctggcctcacgcagcaaccaggtggcaccgtggttgcgggagccgtggcgggggcactgggagccttcgtggggagccctgcttacctgatcaaaacgcagctgcaagctcagacagtggccgcagtggccgtgggacaccagcacaatcaccagactgtcctgggtgccttggagaccatctggcggcagcaagggctcttggggctgtggcagggcgttggtggggctgtgccccgagtcatggtgggctcagctgcccagctggccaccttcgcctctgccaaggcctgggtacagaagcaacagtggctccctgaggacagctggctggtggccctggctgggggcatgatcagcagcatagccgtggttgtcgtcatgactcccttcgatgtggtcagcacgcggctatacaatcagccggtggacacagctggcaggggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggcccacccaggtccagagcatccacttcaagttaccacccattctgtcttccagacagttctcttccttctctgtactgcgtactgggtcaccacatcccagagccttgctcagttatagcaactgctgcgggcgtgcacatggcataggcccagtaacttacatacatcggctcacttaggcctcagacagcagcacgaggcaggcacttttacttcttttaccattagaaagccaaggcctagagtggtgggctttgaccacagccacacaattttgaagtggcagagccaggactggagcttagccctgctcaccctagacctatgcgcttgacaagtgcgtgactgtgacaggcccatgggcccggactgcccataggggtcactgtaccatggcaaaggctgaggtgcaccaggaggctgtggcgtcgtcacctgccttatttgctggagaagctgtagcaaagaaccacagactgggcgacttagacaatagaaatgtattttctcacagttctggaggctggatgctggagaccaaggtgtcagtgggctggtttcttctgaggcctctgtccatggcttgcagatgctgctttctctctgtgtctgcacatggtggtccctcgatgtgcgtctgggtcctgatctcctcctcttataaggacacaaatcatgttggcttagggcccaccctcatgaccccactttaatttttttttttttttttgagatgaagtctcactctgccacccaagctggagtgcagtggcacgatctcggttcactgcaaccttggcctcctaggttcaagcaattctcctgccccagcctcctgagtagctgggattacaggtgtgtgccaccacacccggccaatttttgtatctttagtagagatggggttttgccatgttggccagactggtctcgaactcctgacctcaagtgatccactggccttggcctcccaaagtgctgggattacaggcatgagccacctcacttggcccaattttaacttaattatctctgtcaagagcctatctccatatacagtcacatcctgagctactagggggtaggacttcaacatgcacttctgcaggggccgcagttcagccaacatcatctttttttttgagatggagtctcgctttgttgcccaggctggagtgcggtggtgcaatctcggctcaccacaacctccacctcccaggttcaagtgattctcctgcctcagcctcccgagttgctgggactataggtgtgcgccaccatgcccagctaattttgtatttttagtagagacaggctttcgctgtgttggccaggctggtcttgaatgcctgaccttgccgcccgcctcggcctcccaaaatgctgggattacaggcgtgagccaccgcgcctggcctcagccaacatcatctaagggctctcacggagggcctcccagctgcccgccctgtgggcatttgcacatatcctgacaagcctgaaagaagctccgggtgcccattgttcagtccaggtgcccattgttcccgggactgaggcccgggaaagggaagcgacgtggcagggccagcagcagaccctgggcctttctctagactgagcaccattccccgtgggtgtgctctcagcgccgcaccgaccttcacactgcagagatggatgccaactccctggcaggggcaggactgctgccgagcagccccacctgccctcccagccacaccccaagtctgtaagggccgctcccaggaacacctgctactgcacactccaaaccaataaagttttatattttgtttacttcaacgac

SEQ ID NO: 183503 - DNA, 2785 bp, Homo sapiens
  Payload ID: 16152
  Gene Symbol: SLC25A35
  Gene Name: solute carrier family 25, member 35
  Uniprot ID: Q3KQZ1
  ENST ID: ENST00000380067
  CDS Start-End: 46-933
ttactttcttactcttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatgagatacccgcccgttccttcctccttacgggggctgattgaaggtaagcaagagatcagtctggtactggggcagcctcagcaaggcctgatgaagtgtcacgtcctttgctacctaaggggatcagagtcaggatgcttacctggatctctgcgtccccgctaccgcccttccaggacattacacactctcgggccctcacctgctggttttccttagctatctgctgcttgccagagaggacccaggcttcttgacagcggcccctcagggccaggttctccaaactgagaggctgaacagactccacatggacagccctagccccctgcacgccaccaacatcctcaaagtggtacctggagtagggaagcggggtcaggaagggacatctctggtcgcctccccgggagcatctttaagttgcaggcctggctcccggcccgtgcgtggtctcaccgcccggattaaccgtcggccgcgggccccgcccactggtccgaccccgcccctgccattggccagccgggggccattccctcaccgcgcagccgcttcgccccgtacgtgggcctgcagctcgagaagttccactatcaggctctggtccgtcacgggatggcagaaaacttcttgattgtccgggaccggtcggaggtcgctggagtgaggcgaggcagaccctggttgaccccggtctcttcccacaacccacccagtcagccgcccctgggcgccccggccttctcaccttacgtcaatggcccccatggggaggatggcggaaaaggcgcccccgaacagcgggcagtctctcgtgggctccatgggtctgaggctgggttatgggcattagaaaggtttaaaagaagtccacattgggtcacgtggcatcggctccctgggtttcgcagctgccaccgccacccgggtctggcttagctcccggatcctttaagatttggctccgccctgcgctctcgttggccaatcggcgccaagaccctgggggcgggggtcagcggctttgctccggaagccgcgctcttaggagtgcgcctggcgggacggtggggtctgccttggggttggacttagggttagggtctatgtcgcccccggtggtcacgagcatgctcccgccagcctcctcttgattgattgattgattgattgattgacaggtctcgctgtgtcgcccaggctgtaatgcagtggcgcgatcaccgctcactgcagtctccacctccaggactcaagtgatactcctgcctcagcctcttgagtggctcctgctcccgccaccacgcccggctaaatttttaattacttgtagaaatggggcggggtggggagtgtctcccaatcttgcccaggctggcctcaaactcctggactcaagcgatcctcccgcctcggctccctaagtgctggaattacaggcgagagccacagcgcctggcctcctcgtccttttcaagtggtcacaccttccaagaaggtcgcctgagaccctcctgaggggcaggtgctcgtcaaaggggcccacgtctaggtagggtctcttgagtcaggaaagcatagtttcacggtgttctgggcctctgaaagaagaatgggctgccacccagaccgctaattcatagatctgctgctgggaattaggggaacaatgcgtccaggttaggattcaggtctcacatcttcctgaaagtgagagccaacctgggtattagaaatctaattcctctcaaatatttgccttgggaatgctcccgggcaggtgcaaccccacccccagctccacacacctggacagaagcacagattaaaccctcttttgtttgtctttt

SEQ ID NO: 183504 - DNA, 2136 bp, Homo sapiens
  Payload ID: 16152
  Gene Symbol: SLC25A35
  Gene Name: solute carrier family 25, member 35
  Uniprot ID: Q3KQZ1
  ENST ID: ENST00000579192
  CDS Start-End: 537-1424
gagctccggtggctgcctggggacgctcagggacgctcattcctggccagagtcctgacttctttctcggatcgagatctcgttgctggctcgaggaaatcaccggctcttctcccggatccttttcttctctcacttgctggctttcttcttcctgcctccctggcttccatctcccaaccccgcgattccctcctctactcccgtgctcccgtcgcccgccatcctgagccatcccacctgcaaccttctgtcttttgcccctccttgacctcagagggtcctgccttaagcttctcaccagaatctcctagatttctatctcttccctgcttgccagctcttgactcccaaattccagctgacgtttgaccacttgacatttgaccctgacacccttgactgcaaatctaaattcttatcttctgcaacctgtactgctgaaacaggccttccccctgtcttccaaccccgctttctgacacccatttttactttcttactcttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatgagatacccgcccgttccttcctccttacgggggctgattgaaggtctcgctgtgtcgcccaggctgtaatgcagtggcgcgatcaccgctcactgcagtctccacctccaggactcaagtgatactcctgcctcagcctcttgagtggctcctgctcccgccaccacgcccggctaaatttttaattacttgtagaaatggggcggggtggggagtgtctcccaatcttgcccaggctggcctcaaactcctggactcaagcgatcctcccgcctcggctccctaagtgctggaattacaggcgagagccacagcgcctggcctcctcgtccttttcaagtggtcacaccttccaagaaggtcgcctgagaccctcctgaggggcaggtgctcgtcaaaggggcccacgtctaggtagggtctcttgagtcaggaaagcatagtttcacggtgttctgggcctctgaaagaagaatgggctgccacccagaccgctaattcatagatctgctgctgggaattaggggaacaatgcgtccaggttaggattcaggtctcacatcttcctgaaagtgagagccaacctgggtattagaaatctaattcctctcaaatatttgccttgggaatgctcccgggcaggtgcaaccccacccccagctccacacacctggacagaagcacagattaaaccctcttttgtttgtctttta

SEQ ID NO: 183505 - DNA, 1541 bp, Homo sapiens
  Payload ID: 16152
  Gene Symbol: SLC25A35
  Gene Name: solute carrier family 25, member 35
  Uniprot ID: Q3KQZ1
  ENST ID: ENST00000580340
  CDS Start-End: 32-919
ttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatgagatacccgcccgttccttcctccttacgggggctgattgaaggacattacacactctcgggccctcacctgctggttttccttagctatctgctgcttgccagagaggacccaggcttcttgacagcggcccctcagggccaggttctccaaactgagaggctgaacagactccacatggacagccctagccccctgcacgccaccaacatcctcaaagtggtacctggagtagggaagcggggtcaggaagggacatctctggtcgcctccccgggagcatctttaagttgcaggcctggctcccggcccgtgcgtggtctcaccgcccggattaaccgtcggccgcgggccccgcccactggtccgaccccgcccctgccattggccagccgggggccattccctcaccgcgcagccgcttcgccccgtacgtgggcctgcagctcgagaagttccactatcaggctctggtccgtcacgggatggcagaaaacttcttgattgtccgggaccggtcggaggtcgctggagtgaggcgaggcagaccctggttgaccccggtctcttcccacaacccacccagtcagccgcccctgggcgccccggccttctcaccttac

SEQ ID NO: 183506 - DNA, 1573 bp, Homo sapiens
  Payload ID: 16152
  Gene Symbol: SLC25A35
  Gene Name: solute carrier family 25, member 35
  Uniprot ID: Q3KQZ1
  ENST ID: ENST00000585311
  CDS Start-End: 30-905
gggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagggcctcatgtaccgggggatactggacgctctgctgcagacagctcggaccgagggcatttttggcatgtacaaggaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatgagatacccgcccgttccttcctccttacgggggctgattgaagctatctgctgcttgccagagaggacccaggcttcttgacagcggcccctcagggccaggttctccaaactgagaggctgaacagactccacatggacagccctagccccctgcacgccaccaacatcctcaaagtggtacctggagtagggaagcggggtcaggaagggacatctctggtcgcctccccgggagcatctttaagttgcaggcctggctcccggcccgtgcgtggtctcaccgcccggattaaccgtcggccgcgggccccgcccactggtccgaccccgcccctgccattggccagccgggggccattccctcaccgcgcagccgcttcgccccgtacgtgggcctgcagctcgagaagttccactatcaggctctggtccgtcacgggatggcagaaaacttcttgattgtccgggaccggtcggaggtcgctggagtgaggcgaggcagaccctggttgaccccggtctcttcccacaacccacccagtcagccgcccctgggcgccccggccttctcaccttacg

SEQ ID NO: 183507 - DNA, 1860 bp, Homo sapiens
  Payload ID: 16152
  Gene Symbol: SLC25A35
  Gene Name: solute carrier family 25, member 35
  Uniprot ID: Q3KQZ1
  ENST ID: ENST00000577745
  CDS Start-End: 512-1414
ctcagggacgctcattcctggccagagtcctgacttctttctcggatcgagatctcgttgctggctcgaggaaatcaccggctcttctcccggatccttttcttctctcacttgctggctttcttcttcctgcctccctggcttccatctcccaaccccgcgattccctcctctactcccgtgctcccgtcgcccgccatcctgagccatcccacctgcaaccttctgtcttttgcccctccttgacctcagagggtcctgccttaagcttctcaccagaatctcctagatttctatctcttccctgcttgccagctcttgactcccaaattccagctgacgtttgaccacttgacatttgaccctgacacccttgactgcaaatctaaattcttatcttctgcaacctgtactgctgaaacaggccttccccctgtcttccaaccccgctttctgacacccatttttactttcttactcttgggtcagttcctgctacagctatcccaccatggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagggcctcatgtaccgggggatactggacgctctgctgcagacagctcggaccgagggcatttttggcatgtacaagggtataggtgcctcctacttccgcctcggcccccacaccatcctctccctcttcttctgggaccagctgcgctccctctactacacagacactaaataacagccgctttcccagtctccaccaaatgagcactccttggccacttgtgcctccaccactatgtcctggtgactactgattaggtgacctttcatccatccatgggggacagccaaccccactccccatctgttctcagggttgaatcactacaagagatgagtttcccttctttccttgggtgttgctttaaaccttccctacccattccctgggtaactcacacccctctctcagggctgaacgagtcatcccaaagtgtatttcctcccactcaccactgccacccttgagtccctcctgctcccatgcacagttttaaactcctccctccaaaaccaaagggaatcgagagacccaattcccaggcgtctgggacccaggtgtcctgttagattcaaaggcacagagattatattgattataaagcaagtttattctgaaga

SEQ ID NO: 183508 - DNA, 952 bp, Homo sapiens
  Payload ID: 16152
  Gene Symbol: SLC25A35
  Gene Name: solute carrier family 25, member 35
  Uniprot ID: Q3KQZ1
  ENST ID: ENST00000579681
  CDS Start-End: 1-864
atggacttcttgatgagtggcctggcagcctgcggggcctgtgtattcaccaatcccctggaggtggtgaagaccaggatgcagttgcaaggagaactgcaggcccctggcacataccagcggcactaccgaaatgtcttccatgccttcatcaccatcggcaaggtggatggccttgctgccctgcagaaaggcctggcccccgccctcttgtaccagttcctgatgaatggcatccgactgggcacctatgggctggctgaggctgggggctacctgcacacagccgaaggcacccacagtcctgcccgcagcgcagcagctggggccatggctggggtcatgggagcctacttggggagccccatctacatggtgaagacacacctgcaggcacaggcagcctcagaaattgctgtagggcaccagtataagcatcagggcatgtttcaggcgctaaccgagattggccagaaacatggtctggtggggttatggcgtggggctctgggcggcctgccccgagttatcgtcggttcctccacccagctgtgcaccttctcatccaccaaggacctcctgagccagtgggagatctttcctccccagagctggaagttggcgctggtggctgccatgatgagtggcattgcagttgtcttggccatggcaccctttgatgtggcctgcacaaggctctacaaccagcccacagatgcacagggcaagggcctcatgtaccgggggatactggacgctctgctgcagacagctcggaccgagggcatttttgaaccgagtccccaagttctcagcaacatcatgcagtgcttcagcgcctttactggggaccaaagatgttaggatcgtgaagggtcagactggtcaccagctgttcaaagtcacccaggctccagggtgcagcccgattctcctgggaacccagtcatga

SEQ ID NO: 183509 - DNA, 2123 bp, Homo sapiens
  Payload ID: 16153
  Gene Symbol: SLC25A38
  Gene Name: solute carrier family 25, member 38
  Uniprot ID: Q96DW6
  ENST ID: ENST00000273158
  CDS Start-End: 378-1292
gaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctgcaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaagctgtttggaaaacctaaaagatgttgtcacacttctgttttctttacctgtgccttataaaaatggaccaaacccttttctaaaataaaatagttctagggtggctggttattgacctatgtaggtccctaaaacctaa

SEQ ID NO: 183510 - DNA, 820 bp, Homo sapiens
  Payload ID: 16153
  Gene Symbol: SLC25A38
  Gene Name: solute carrier family 25, member 38
  ENST ID: ENST00000431510
  CDS Start-End: 377-820
ctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatggtatgaagaaaacatgaggcaccaccagttacatccggtgatcaaggctttcctgtgtggctccatcagtgggacctgctctaccctccttttccaacctctggatctccttaaaacacgcctgcaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgag

SEQ ID NO: 183511 - DNA, 1607 bp, Homo sapiens
  Payload ID: 16154
  Gene Symbol: SLC25A39
  Gene Name: solute carrier family 25, member 39
  Uniprot ID: Q9BZJ4
  ENST ID: ENST00000225308
  CDS Start-End: 176-1231
ggggcctcgtggcgcggtgtaggggcggggcccccttggctgctttcggcgtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttctgc

SEQ ID NO: 183512 - DNA, 1565 bp, Homo sapiens
  Payload ID: 16154
  Gene Symbol: SLC25A39
  Gene Name: solute carrier family 25, member 39
  Uniprot ID: Q9BZJ4
  ENST ID: ENST00000377095
  CDS Start-End: 121-1200
cctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatga

SEQ ID NO: 183513 - DNA, 1274 bp, Homo sapiens
  Payload ID: 16154
  Gene Symbol: SLC25A39
  Gene Name: solute carrier family 25, member 39
  ENST ID: ENST00000537904
  CDS Start-End: 133-1143
tttcggcgtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctcca

SEQ ID NO: 183514 - DNA, 839 bp, Homo sapiens
  Payload ID: 16154
  Gene Symbol: SLC25A39
  Gene Name: solute carrier family 25, member 39
  ENST ID: ENST00000588049
  CDS Start-End: 347-839
cggcctaggtgcgctgcgagcgcgcgcggaccgcgcacaggcggcggagccggtatgggcccgcctgaccctgggcgccgcgccgcacgagcaccagcctagagccaggcgtggtggtgcgcgcctgtagtcccagctacttgggaggctgaagcaagagaaccgcttgaacgggggtggatgttgcagtgagccaagatggtgccactgcactccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcc

SEQ ID NO: 183515 - DNA, 561 bp, Homo sapiens
  Payload ID: 16154
  Gene Symbol: SLC25A39
  Gene Name: solute carrier family 25, member 39
  ENST ID: ENST00000585636
  CDS Start-End: 133-561
tttcggcgtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgtgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacc

SEQ ID NO: 183516 - DNA, 566 bp, Homo sapiens
  Payload ID: 16154
  Gene Symbol: SLC25A39
  Gene Name: solute carrier family 25, member 39
  ENST ID: ENST00000586633
  CDS Start-End: 270-566
gcgtcggcctaggtgcgctgcgagcgcgcgcggaccgcgcacaggcggcggagccggtatgggcccgcctgaccctgggcgccgcgccgcacgagcaccagcctagagccagtgagccaagatggtgccactgcactccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcacc

SEQ ID NO: 183517 - DNA, 574 bp, Homo sapiens
  Payload ID: 16154
  Gene Symbol: SLC25A39
  Gene Name: solute carrier family 25, member 39
  ENST ID: ENST00000585523
  CDS Start-End: 359-574
tgctttcggcgtcggcctaggtgcgctgcgagcgcgcgcggaccgcgcacaggcggcggagccggtatgggcccgcctgaccctgggcgccgcgccgcacgagcaccagcctagagccaggcgtggtggtgcgcgcctgtagtcccagctacttgggaggctgaagcaagagaaccgcttgaacgggggtggatgttgcagtgagccaagatggtgccactgcactccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacaggg

SEQ ID NO: 183518 - DNA, 807 bp, Homo sapiens
  Payload ID: 16154
  Gene Symbol: SLC25A39
  Gene Name: solute carrier family 25, member 39
  ENST ID: ENST00000588767
  CDS Start-End: 1-801
gaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagtgcatcccccaccccaagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaagggg

SEQ ID NO: 183519 - DNA, 1156 bp, Homo sapiens
  Payload ID: 16154
  Gene Symbol: SLC25A39
  Gene Name: solute carrier family 25, member 39
  ENST ID: ENST00000586016
  CDS Start-End: 145-828
acaggcggcggagccggtatgggcccgcctgaccctgggcgccgcgccgcacgagcaccagcctagagccaggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtc

SEQ ID NO: 183520 - DNA, 1542 bp, Homo sapiens
  Payload ID: 16154
  Gene Symbol: SLC25A39
  Gene Name: solute carrier family 25, member 39
  Uniprot ID: Q9BZJ4
  ENST ID: ENST00000590194
  CDS Start-End: 128-1183
tgcgctgcgagcgcgcgcggaccgcgcacaggcggcggagccggtatgggcccgcctgaccctgggcgccgcgccgcacgagcaccagcctagagccaggtttggttttcaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaa

SEQ ID NO: 183521 - DNA, 837 bp, Homo sapiens
  Payload ID: 16154
  Gene Symbol: SLC25A39
  Gene Name: solute carrier family 25, member 39
  ENST ID: ENST00000592857
  CDS Start-End: 558-837
gccggtatgggcccgcctgaccctgggcgccgcgccgcacgagcaccagcctagagccaggtaggcggcactgggccggggctgggggcggagacggaagcgggggtctccgggcggccgtgcgagccagggcaggtgctggggccgtcgagctggcgtggtccccctcacctggcggctctccgccgttcggggccgggagtgtcgccgagggtcggggagacgtcctggtcctacgttcctacttcccgctctcccggctgcgccccgggcctgcattttggggcgggaacccagagactgctctttctctccgggccccgggtctggcccgtccggccgggcggggagggccgggcatcccagcccgcagtcctgaggaggcgacgggcccttcttggtcaccggatctgtttacacgtcaccctcgatgcccggccgtccctccacgcccagtaacttgggctctcaggaggtgcgcagtggacacgtgcgaggtggacgagggaaggaccctggctcctactgcattcgagcgataggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagacccta

SEQ ID NO: 183522 - DNA, 797 bp, Homo sapiens
  Payload ID: 16154
  Gene Symbol: SLC25A39
  Gene Name: solute carrier family 25, member 39
  ENST ID: ENST00000593166
  CDS Start-End: 1-186
actgcctatgaccaactgaaggccttcctgtgtggtcgagccctgacctctgacctctacgcacccatggtggctggcgcgctggcccgccgtgagcatagtcttgggcctttgacctccctctgtccccacctcggcccaaacccagtcagtcccagctcccagccccaacctctgccagcctagggataggggggtgttctaggtccccagacctgggacagcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttc

SEQ ID NO: 183523 - DNA, 4045 bp, Homo sapiens
  Payload ID: 16155
  Gene Symbol: SLC25A40
  Gene Name: solute carrier family 25, member 40
  Uniprot ID: Q8TBP6
  ENST ID: ENST00000341119
  CDS Start-End: 348-1364
gcctcgctctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataaagcactcgttaaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagtaaatctaattgcctagtcgtttttttaacacatatacatgcaatgtatctggatgaatagaaggctgaattgaagctttctttatatttaagaggtaaaaagaaatattaatacttttaaaatatactaacaaccaaaaagtgttcagaattttgctataataataatttgtattaaaatagtacctagaaaaattcagtctatggaataggtaaaattttaaaattttaatttgctctcagagttctgtctgataaaataattgaactataattggcatgatgaatattcccaggttttacttcagtatataaatttaactctcagccacatgggctttccagacttttcaatacatatgatgttgcaggaattgcaatatttgcaaacatgtgccacaacagtgttcttggtgatgtttctaaaacagtttttattctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgctttta

SEQ ID NO: 183524 - DNA, 636 bp, Homo sapiens
  Payload ID: 16155
  Gene Symbol: SLC25A40
  Gene Name: solute carrier family 25, member 40
  ENST ID: ENST00000446236
  CDS Start-End: 4-117
gcaatgtactggtataactatgaaattttaaagaagtggttatgtgagaaatctggtttatatgagccaacatttatgatcaactttacttcaggggcattgtctggttctgaataatagaacacaaaggagcgtgagaaattgtgaatgctggtagtggagtcagagaggcttggttggaattgtggctctgcaactagtagctgtgtgacctcaggaaatttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctcta

SEQ ID NO: 183525 - DNA, 1077 bp, Homo sapiens
  Payload ID: 16155
  Gene Symbol: SLC25A40
  Gene Name: solute carrier family 25, member 40
  ENST ID: ENST00000429674
  CDS Start-End: 52-162
tagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagataccactcgctaattgaaacttaacatatcttcatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagtttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattc

SEQ ID NO: 183526 - DNA, 702 bp, Homo sapiens
  Payload ID: 16155
  Gene Symbol: SLC25A40
  Gene Name: solute carrier family 25, member 40
  ENST ID: ENST00000444363
  CDS Start-End: 454-564
cttctcgcgcctcgctctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggctggagtgcagtaatgcgatcttggctcattgcaacttctgcctcctgggttaaagggattctcatgcctcagtcccccacggaactgggactacaggtttttatttaattagttaaaaatatggatcctgagacaaggggacaagagattatcaaagtgacacctcttcaacaaatgcttgcctcatgtactggagctatactgacatcagtaatagataccactcgctaattgaaacttaacatatcttcatagtgacacccctggatgttgttaaaattagactccaagcccaaaacaacccactccccaaaggaaaatgttttgtatatagtaatggactcatggatcatctatgtgtctgtgaag

SEQ ID NO: 183527 - DNA, 1532 bp, Homo sapiens
  Payload ID: 16156
  Gene Symbol: SLC25A41
  Gene Name: solute carrier family 25, member 41
  Uniprot ID: Q8N5S1
  ENST ID: ENST00000321510
  CDS Start-End: 70-1182
ctcccgcatggtagctggagcagcaaacaactgcttagggatttgaagccaggtgtcctaacttcctccatgggcgctcagcctggggaacctcagaacacttgctctaggatccagacactgtttaggagggtcaagaccttactcatcaaagccccgcctcccccccaacctccgcctccacccccatcctggaaccctggctgtacacacgtgtatgggtacgcgtttggccacatgcatgacaacaaccttgaacatctcccgtcacagcaggtactggacacaggagagcagctgatggtccccgtggaagtcctggaagtggataacaaggaggccttgtggaagtttctactctcaggagctatggccggggcggtgtctcgcacgggcacggcacctctggacagagccaaggtgtacatgcaggtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcagtgcaagaattacttctgtggaatacaagggtccccgcccttccaggagcgtctccttgctggctccctggctgtggccatctcccagaccctcatcaaccccatggaggtgctgaagacgcggttgaccttgcgtcggacgggccagtacaaggggctgctggactgcgccaggcagatcttgcagcgagagggcacccgcgccctttaccgcggctacctgcccaatatgctcggcatcatcccctatgcctgcaccgacctggctgtctatgagatgctccagtgcttctgggtgaagtcaggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagattcctgaagctggggttggtggtgggtggaggggggcagtgctgggtcagaaaactcctgggactccctccccagggtgcagcctgagacaagaaacgtggactccagtctggccccttgtgggtcgtcctggctccagggcgaaatggtgaacatgtcacacaacaaggaataaagagatggtttttgctg

SEQ ID NO: 183528 - DNA, 1630 bp, Homo sapiens
  Payload ID: 16156
  Gene Symbol: SLC25A41
  Gene Name: solute carrier family 25, member 41
  Uniprot ID: Q8N5S1
  ENST ID: ENST00000458275
  CDS Start-End: 70-798
ctcccgcatggtagctggagcagcaaacaactgcttagggatttgaagccaggtgtcctaacttcctccatgggcgctcagcctggggaacctcagaacacttgctctaggatccagacactgtttaggagggtcaagaccttactcatcaaagccccgcctcccccccaacctccgcctccacccccatcctggaaccctggctgtacacacgtgtatgggtacgcgtttggccacatgcatgacaacaaccttgaacatctcccgtcacagcaggtactggacacaggagagcagctgatggtccccgtggaagtcctggaagtggataacaaggaggccttgtggaagtttctactctcaggagctatggccggggcggtgtctcgcacgggcacggcacctctggacagagccaaggtgtacatgcagctactcgggaggctgaggcaggagaatcgcctgaacctgggaggcggaggttgcagtgagccgagatcccccgaccgcactccagcctgggcgacagagtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcagtgcaagaattacttctgtggaatacaagggtccccgcccttccaggagcgtctccttgctggctccctggctgtggccatctcccagaccctcatcaaccccatggaggtgctgaagacgcggttgaccttgcgtcggacgggccagtacaaggggctgctggactgcgccaggcagatcttgcagcgagagggcacccgcgccctttaccgcggctacctgcccaatatgctcggcatcatcccctatgcctgcaccgacctggctgtctatgagatgctccagtgcttctgggtgaagtcaggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagattcctgaagctggggttggtggtgggtggaggggggcagtgctgggtcagaaaactcctgggactccctccccagggtgcagcctgagacaagaaacgtggactccagtctggccccttgtgggtcgtcctggctccagggcgaaatggtgaacatgtcacacaacaaggaataaagagatggtttttgctg

SEQ ID NO: 183529 - DNA, 1405 bp, Homo sapiens
  Payload ID: 16156
  Gene Symbol: SLC25A41
  Gene Name: solute carrier family 25, member 41
  Uniprot ID: Q8N5S1
  ENST ID: ENST00000597558
  CDS Start-End: 87-1199
aatcctcccactagacactcccgcatggtagctggagcagcaaacaactgcttagggatttgaagccaggtgtcctaacttcctccatgggcgctcagcctggggaacctcagaacacttgctctaggatccagacactgtttaggagggtcaagaccttactcatcaaagccccgcctcccccccaacctccgcctccacccccatcctggaaccctggctgtacacacgtgtatgggtacgcgtttggccacatgcatgacaacaaccttgaacatctcccgtcacagcaggtactggacacaggagagcagctgatggtccccgtggaagtcctggaagtggataacaaggaggccttgtggaagtttctactctcaggagctatggccggggcggtgtctcgcacgggcacggcacctctggacagagccaaggtgtacatgcaggtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcagtgcaagaattacttctgtggaatacaagggtccccgcccttccaggagcgtctccttgctggctccctggctgtggccatctcccagaccctcatcaaccccatggaggtgctgaagacgcggttgaccttgcgtcggacgggccagtacaaggggctgctggactgcgccaggcagatcttgcagcgagagggcacccgcgccctttaccgcggctacctgcccaatatgctcggcatcatcccctatgcctgcaccgacctggctgtctatgagatgctccagtgcttctgggtgaagtcaggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaagggtgcagcctgagacaagaaacgtggactccagtctggccccttgtgggtcgtcctggctccagggcgaaatggtgaacatgtcacacaacaaggaataaagagatggtttttgctgaa

SEQ ID NO: 183530 - DNA, 3120 bp, Homo sapiens
  Payload ID: 16157
  Gene Symbol: SLC25A42
  Gene Name: solute carrier family 25, member 42
  Uniprot ID: Q86VD7
  ENST ID: ENST00000318596
  CDS Start-End: 152-1108
ggggccgtggcggctggaggtagcggcggcggcgacgcgtccgggccggtgagggggcgcggggggcgccgggggggcccaagcgtcagcggcccgcgcctgtcgggctgaactgaggaccgagtctcctgccattccgagcaggcctggtatgggtaatggtgtgaaggaaggcccggtgcgattgcatgaggatgctgaggctgtcctgtcctcgtccgtctcatcaaagcgtgaccacaggcaagtgctcagctccctgctgtctggggccctggctggtgcccttgccaaaacagcggtagctcccctggaccgaaccaaaatcatcttccaagtgtcttcaaaaagattttctgccaaggaggccttccgggtcctctactacacctacctcaacgagggatttctcagcttgtggcgcgggaactcggccaccatggtgcgcgtggtgccctacgccgccatccagttcagcgcacacgaggagtacaagcgcatcctgggcagctactatggcttccgtggagaagccctgcccccttggcctcgcctcttcgccggcgcactggctggaacgacagccgcttcactgacctaccccctggacctggtcagagcgcggatggccgtaaccccgaaggaaatgtacagcaacatctttcatgtcttcatccgcatctcgagagaagaggggctgaagactctctaccatggatttatgcccaccgtgctgggggtcattccctacgctggcctgagcttcttcacctatgagacgctcaagagcttgcacagagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagaccgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggaaaatctgaggtacccaggggaacccccagctaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttct

SEQ ID NO: 183531 - DNA, 2783 bp, Homo sapiens
  Payload ID: 16158
  Gene Symbol: SLC25A43
  Gene Name: solute carrier family 25, member 43
  Uniprot ID: Q8WUT9
  ENST ID: ENST00000217909
  CDS Start-End: 345-1370
cagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaagaaaaaa

SEQ ID NO: 183532 - DNA, 3482 bp, Homo sapiens
  Payload ID: 16159
  Gene Symbol: SLC25A44
  Gene Name: solute carrier family 25, member 44
  Uniprot ID: Q96H78
  ENST ID: ENST00000359511
  CDS Start-End: 173-1117
tttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccacttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 183533 - DNA, 3662 bp, Homo sapiens
  Payload ID: 16159
  Gene Symbol: SLC25A44
  Gene Name: solute carrier family 25, member 44
  ENST ID: ENST00000423538
  CDS Start-End: 330-1298
actgcccaaatccaagatggctaccaggaggccgtcagttctcggaagtgcggcacatcctcactcctgggaggctcaaaggctcaaacgccattggcagaatccccgacagctcatcctccgccccctgcagggggcggtaatgacagagtcctaatttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagccattgtctttccctggattccagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccacttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccg

SEQ ID NO: 183534 - DNA, 2196 bp, Homo sapiens
  Payload ID: 16160
  Gene Symbol: SLC25A45
  Gene Name: solute carrier family 25, member 45
  Uniprot ID: Q8N413
  ENST ID: ENST00000294187
  CDS Start-End: 243-983
agaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatga

SEQ ID NO: 183535 - DNA, 2286 bp, Homo sapiens
  Payload ID: 16160
  Gene Symbol: SLC25A45
  Gene Name: solute carrier family 25, member 45
  Uniprot ID: Q8N413
  ENST ID: ENST00000398802
  CDS Start-End: 205-1071
agatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 183536 - DNA, 561 bp, Homo sapiens
  Payload ID: 16160
  Gene Symbol: SLC25A45
  Gene Name: solute carrier family 25, member 45
  ENST ID: ENST00000530936
  CDS Start-End: 208-561
cacagatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggct

SEQ ID NO: 183537 - DNA, 2432 bp, Homo sapiens
  Payload ID: 16160
  Gene Symbol: SLC25A45
  Gene Name: solute carrier family 25, member 45
  Uniprot ID: Q8N413
  ENST ID: ENST00000534028
  CDS Start-End: 423-1217
atgggggcggccatgccccttggtggagatgaatgggagtggagctgggctggctgggcaggcaggggcttgcctcttgctgactaaggcagccctggaggggcccgaccatggggcaggaacccagttgccatcctcagagcgaggatcattggccgggctcggggatcagggcctctgtggtcccggcacgcctggcccgtgagactgtactctgcacgactcctccaggtggccagggtcaccggaactggctcgctctcctctgccagttgccggaggtctgggcaccaggccaattctcaccttcccgccagggttaaacattagtgggaggttatcagcgtgggccaggggagggagaggggggaattcaactctgtctcctctgctggagccaccagttcccgcaagcccagacaatgccggtggaggaatttgtggctggctggatctctggcgctctgggcttggtcctgggacacccgtttgacactgtaaagctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 183538 - DNA, 1012 bp, Homo sapiens
  Payload ID: 16160
  Gene Symbol: SLC25A45
  Gene Name: solute carrier family 25, member 45
  ENST ID: ENST00000533629
  CDS Start-End: 165-275
tgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggtgagacatttttcttccttctgtcacatcacacccaatggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggtatgctcactgccggctttagggaggccagaaaccaacctgctcctgcaaaaagaatccaggcttgttctgagtgcctgctgtaggccaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtac

SEQ ID NO: 183539 - DNA, 603 bp, Homo sapiens
  Payload ID: 16160
  Gene Symbol: SLC25A45
  Gene Name: solute carrier family 25, member 45
  ENST ID: ENST00000524438
  CDS Start-End: 207-350
acagatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggtgagacatttttcttccttctgtcacatcacacccaatgggccctgcagttctgcgtggccagctggcagcagggcctgctctggatcccggcgacgacattatgagttgaagaaagaagagtaaagctctcggagaggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggcc

SEQ ID NO: 183540 - DNA, 572 bp, Homo sapiens
  Payload ID: 16160
  Gene Symbol: SLC25A45
  Gene Name: solute carrier family 25, member 45
  ENST ID: ENST00000526259
  CDS Start-End: 28-138
agccaccagttcccgcaagcccagacaatgccggtggaggaatttgtggctggctggatctctggtgagacatttttcttccttctgtcacatcacacccaatggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctggg

SEQ ID NO: 183541 - DNA, 3088 bp, Homo sapiens
  Payload ID: 16160
  Gene Symbol: SLC25A45
  Gene Name: solute carrier family 25, member 45
  ENST ID: ENST00000526898
  CDS Start-End: 812-955
actgcaacagctgcctctcgggttcaagcgattctcctgcctcagcatcccaagtagctgggactacaggcgcccgtcatcacacccggctaatttttgtatttttggtagagatggggtttcactatgttggtcaggctggtctcgaactcctgacctcaggtggtccttccgcctcggcctcccaaagtgctgggattacaggcgtgagccactgcgcctggcctgtatcagttatagtttttgcaaaggcagtttcaggaataagaagcagaaccaggactgcagcccaagccaccacgagaggccagtctttggggatggtcttttaggatgatctttgggggtggcccaaggagccccaggcagctccagaggcaggagtcactcaggatttattgagagcccaccctgtgccacccgctgtgcacagaacacccagagatccctgtccagacagacaagttcttcccatcgtatgttggcgtgataactgtgatggagaaagagaggaagagccagcagtgcctccggctggggaggcggggcagacctcacccaggtggtgacatttgagccccagctggaggggtgccagggcaagagtgcccaggaagagggaagagccagtccacaggcctggagacagaaggctgactgaagaagagtctggaggctcgggtggctgcagcagagaaagcaagggggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggtgagacatttttcttccttctgtcacatcacacccaatgggccctgcagttctgcgtggccagctggcagcagggcctgctctggatcccggcgacgacattatgagttgaagaaagaagagtaaagctctcggagagacttgcttcctgggcctggcacgagggccctcactcatagcaccctcttgtcaccacaggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatg

SEQ ID NO: 183542 - DNA, 569 bp, Homo sapiens
  Payload ID: 16160
  Gene Symbol: SLC25A45
  Gene Name: solute carrier family 25, member 45
  ENST ID: ENST00000529962
  CDS Start-End: 179-331
actgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggtgagacatttttcttccttctgtcacatcacacccaatgttctgcgtggccagctggcagcagggcctgctctggatcccggcgacgacattatgagttgaagaaagaagagtaaagctctcggagaggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacct

SEQ ID NO: 183543 - DNA, 2138 bp, Homo sapiens
  Payload ID: 16160
  Gene Symbol: SLC25A45
  Gene Name: solute carrier family 25, member 45
  Uniprot ID: Q8N413
  ENST ID: ENST00000527174
  CDS Start-End: 57-923
ggggaattcaactctgtctcctctgctggagccaccagttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggaatgcagtggcgtgatctcggctcactgcaacctccgcctttccaccttccgggttcaagcaactctcctgcctcagcctcccaagtagctgggactataggcgcccgccaccacacccagctaaatttttgtatttttagtagagacagggtttcaccatgtcagccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatgatg

SEQ ID NO: 183544 - DNA, 894 bp, Homo sapiens
  Payload ID: 16160
  Gene Symbol: SLC25A45
  Gene Name: solute carrier family 25, member 45
  ENST ID: ENST00000526432
  CDS Start-End: 1-681
atgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccgcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacatgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttga

SEQ ID NO: 183545 - DNA, 2385 bp, Homo sapiens
  Payload ID: 16161
  Gene Symbol: SLC25A46
  Gene Name: solute carrier family 25, member 46
  Uniprot ID: Q96AG3
  ENST ID: ENST00000355943
  CDS Start-End: 127-1383
acttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaa

SEQ ID NO: 183546 - DNA, 1575 bp, Homo sapiens
  Payload ID: 16161
  Gene Symbol: SLC25A46
  Gene Name: solute carrier family 25, member 46
  Uniprot ID: Q96AG3
  ENST ID: ENST00000447245
  CDS Start-End: 80-1093
aagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtgaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagact

SEQ ID NO: 183547 - DNA, 1546 bp, Homo sapiens
  Payload ID: 16161
  Gene Symbol: SLC25A46
  Gene Name: solute carrier family 25, member 46
  ENST ID: ENST00000513807
  CDS Start-End: 291-1061
gaaggaacataggatgaaaccatggaagtcttcctcagatctggggagggagcctggcccaagagcccgtggagctaatgaaaacagaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaa

SEQ ID NO: 183548 - DNA, 2345 bp, Homo sapiens
  Payload ID: 16161
  Gene Symbol: SLC25A46
  Gene Name: solute carrier family 25, member 46
  Uniprot ID: Q96AG3
  ENST ID: ENST00000504098
  CDS Start-End: 525-1343
acagtttttgaaatagttgtccaggactttaaaattggaagcttttatataaaatgagaatatctttttttgaaaaaattacaacttcaaaaccctgggcccacactctaatgtggcaacaatgaattggagtgaaagcgtaattgtgctttaaacactctacaccttgcaatttgccacagaccccagcagagtccttcattcatttaaattatttacctggcccctatcagaatttgactttgaggtttaaatgaacagcaggttaataaaataaattttttaaaattgttttgagactaaacctaaattgtcagtaattggttatcagtaatcttatttttttatttctatttttttttactttagaacagctgaatagatttgctggatttggtattggacttgcaagtctctttacagaaaatgtattggcacatccttgcattgttctacgccgccaatgtcaggttaattaccatgctcagcattaccatctcactccatttacagtcatcaatattatgtacagtttcaacaaaactcagggacctagagccctgtggaaaggaatgggaagtacatttattgtccagggagtcacacttggagcagaaggcataattagtgaatttacacctttgccaagggaggttttacataaatggagtcctaaacaaataggagaacaccttctactgaaatccctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaa

SEQ ID NO: 183549 - DNA, 1596 bp, Homo sapiens
  Payload ID: 16161
  Gene Symbol: SLC25A46
  Gene Name: solute carrier family 25, member 46
  ENST ID: ENST00000509432
  CDS Start-End: 548-1165
ttttaatcctgttctttgtttccatatctattctctttcttttaaccaatcatcttaattttcttcctttaatttctcatgtttactttcataatcagttgtgcctcttgcttctctgccagccccttctatcagcacgtatgaaaacaccttgtatttttttctctcaaaccatcacagttgtttacactgtgttctagaaaagaaaatgttcaccattagaatatatttctcctacagattgaaaaaaattagaagttgattactgttttgaaaattgggctaattccagatgttttaaataacatggcttttgttttatttaagtttatttttatgttttagggaggttttacataaatggagtcctaaacaaataggagaacaccttctactgaaatcattgtgaattggaaatcccccagcttgctggctccctcagtgggacattccagcacattattacttagtgatgttccattcaccttgaaaaccactacttgccaggacctggcccataagggttagcctaacttacgtggtggcaatgcctttttattcagcaagtctgattgaaacagtgcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatc

SEQ ID NO: 183550 - DNA, 1738 bp, Homo sapiens
  Payload ID: 16162
  Gene Symbol: SLC25A47
  Gene Name: solute carrier family 25, member 47
  Uniprot ID: Q6Q0C1
  ENST ID: ENST00000361529
  CDS Start-End: 79-1005
gagctgttgaggccaccctggtggcaccaaagccctctcaggcaggcagacccagggcctccccgccacaccttgttcatggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttccgtgtcttttggcacctaccgccactgcctggcgcacatctgccggctccggtacggcaaccctgacgccaagcccaccaaggccgacatcacgctctcgggatgcgcctccggcctcgtccgcgtgttcctgacgtcgcccactgaggtggccaaagtccgcttgcagacgcagacacaggcgcagaagcagcagcggcggctttcggcctcggggccgttggctgtgccccccatgtgtcctgtgcccccagcctgcccagagcccaagtaccgcgggccactgcactgcctggccacggtagcccgtgaggaggggctgtgcggcctctacaagggcagctcggccctggtcttacgggacggccactcctttgccacctacttcctttcctacgcggtcctctgcgagtggctcagccccgctggccacagccggccagatgtcccgggcgtgctggtggccgggggctgtgcaggagtcctggcctgggctgtggccacccccatggacgtgatcaagtcgagactgcaggcagacgggcagggccagaggcgctaccggggtctcctgcactgtatggtgaccagcgttcgagaggagggaccccgggtccttttcaaggggctggtactcaattgctgccgcgccttccctgtcaacatggtggtcttcgtcgcctatgaggcagtgctgaggctcgcccggggtctgctcacatagccggtccccacgcccagcggcccacccaccagcagctgctggaggtcgtagtggctggaggaggcaaggggtagtgtggctgggttcgggaccccacagggccattgcccaggagaatgaggagcctccctgcagtgttgtcggccgaggcctgagctcgccctgcccagctactgacctcaggtcgaggggcccgccagccatcagccagggttggcctagggtggcaggagccagggaggagtgggcctctttgatgagagcgttgagttgcatggagtcggttgttcatcccagcctccccatggccctcgcctcccatgtctttgaagcacccctccagggagtcaggtgtgtgctcagccaccctctgccccattcctagaccctcacccccaccactgttcctgtgtcttcacgagctgtcccttacaggcaggggcttcccacaggctgggggcctcggggcggggagcatgagctgggctggcaccacgactgagggctcccggctcggcttcttccccacagcaggctgctcagagggggtgctgccgggactgccatgcccacctgagaggggcctggggtggccgtcctcggccggttagggaatttggggtgaggttcctcaggagccctcactctgcctgtggacgctgcacctgccacttaaagaccccaaagactctgttgggaactgttgtcaataaaatgtttctgaggatgttca

SEQ ID NO: 183551 - DNA, 1552 bp, Homo sapiens
  Payload ID: 16162
  Gene Symbol: SLC25A47
  Gene Name: solute carrier family 25, member 47
  ENST ID: ENST00000557052
  CDS Start-End: 573-1061
gttgaggccaccctggtggcaccaaagccctctcaggcaggcagacccagggcctccccgccacaccttgttcatggattttgtcgctggagccatcggaggcgtctgcggtgttgctgtgggctaccccctggacacggtgaagggcctgctggccttgccctaggcctggagccgctcgtgcctgaagcccacttctcctgcaggtcaggatccagacggagccaaagtacacaggcatctggcactgcgtccgggatacgtatcaccgagagcgcgtgtggggcttctaccggggcctctcgctgcccgtgtgcacggtgtccctggtatcttccgtgtcttttggcacctaccgccactgcctggcgcacatctgccggctccggtacggcaaccctgacgccaagcccaccaaggccgacatcacgctctcgggatgcgcctccggcctcgtccgcgtgttcctgacgtcgcccactgaggtggccaaagtccgcttgcagacgcagacacaggcgcagaagcagcagcggcggctttcggcctcggggccgttggctgtgccccccatgtgtcctgtgcccccagcctgcccagagcccaagtaccgcgggccactgcactgcctggccacggtagcccgtgaggaggggctgtgcggcctctacaagggcagctcggccctggtcttacgggacggccactcctttgccacctacttcctttcctacgcggtcctctgcgagtggctcagccccgctggccacagccggccagatgtcccgggcgtgctggtggccgggggctgtgcaggagtcctggcctgggctgtggccacccccatggacgtgatcaagtcgagactgcaggcagacgggcagggccagaggcgctaccggggtctcctgcactgtatggtgaccagcgttcgagaggagggaccccgggtccttttcaaggggctggtactcaattgctgccgcgccttccctgtcaacatggtggtcttcgtcgcctatgaggcagtgctgaggctcgcccggggtctgctcacatagccggtccccacgcccagcggcccacccaccagcagctgctggaggtcgtagtggctggaggaggcaaggggtagtgtggctgggttcgggaccccacagggccattgcccaggagaatgaggagcctccctgcagtgttgtcggccgaggcctgagctcgccctgcccagctactgacctcaggtcgaggggcccgccagccatcagccagggttggcctagggtggcaggagccagggaggagtgggcctctttgatgagagcgttgagttgcatggagtcggttgttcatcccagcctccccatggccctcgcctcccatgtctttgaagcacccctccagggagtcaggtgtgtgctcagccaccctctgccccattcctagaccctcacccccaccactgttcctgtgtcttcacgagctgtcccttacaggcaggggcttcccacaggctgggggcctcggggcggggagcatgagctgggctggc

SEQ ID NO: 183552 - DNA, 1880 bp, Homo sapiens
  Payload ID: 16163
  Gene Symbol: SLC25A48
  Gene Name: solute carrier family 25, member 48
  Uniprot ID: Q6ZT89
  ENST ID: ENST00000274513
  CDS Start-End: 173-1048
agcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggtaagggcagcagcagctggagccgcacccctgtgcaggccacagcagtgggacagctggggaactgccatgcccttctcagcccagggggagggcaggacacatttaggtactcacccaacaattctttgttaggtacctactctgtccccggccctctcccacctcagtctcatcccttccctatgcagctatgagaatggcagttcccatttgactttcaggcaacagatatattttgaacacatactctgtgtcaggcattactaagctttggaaaggaaatccattatcatggttcagtttattaaatgcaatctttgtaatgtaaggatgccattagttctacaaggtaggaatcggtttccccatttcacagatgagaaaactcaggtccagaaatgttaagtagccaatcccaggtcatacagctggagctgacagtatagcaggactctgcagtcagaaagatttaagttcaaatccacacttcatcattttgtgaccatggacttgttgcttaacctccctgctcagaatcctgcaccacatccttctttcatttaaggtaaaagttgatatctttgcaatggttttccaggccctcagtgatctagctccctgttccccacccacctcacttctactcctctccccttcctcactttctccagtcacactggtctctgctgcaacttgaccatgcctggcccttccctgaccacagggcctttgtacctgctactcaccacctcctgaatttaacaacgtggagaccactggggattttggcaagggccatttgatggagagaagggtgtaaaaacctgatgaagtgggataaagaaagaatgggatgaaggatattggtgcacccaagtatacacaactcttctgagggttctgctatgctgtaatgaggaacagagaaacagagccatagccagaagggcctttggaagccaagagaggatactttttaagaaggctgacatcatgacatgtttgatgtgatgggaaagatctaac

SEQ ID NO: 183553 - DNA, 1111 bp, Homo sapiens
  Payload ID: 16163
  Gene Symbol: SLC25A48
  Gene Name: solute carrier family 25, member 48
  ENST ID: ENST00000433282
  CDS Start-End: 297-1070
gtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggagcaatttcttgggggacagcgactcctatggatgtcgtgaaaagtcgactccaagctgatggggtttatttaaacaaatataaaggtgtcctggactgtatctcccagagttaccagaaggaaggtcttaaagtgtttttcagaggcatcactgtgaacgcggtgcggggcttccccatgagtgcggccatgttccttgggtacgagctgtcgctgcaggctatccgcggggaccacgcagtgacgagcccataagcgccaggtcagtgtgcttccatcctggccaattgtgcctc

SEQ ID NO: 183554 - DNA, 2062 bp, Homo sapiens
  Payload ID: 16163
  Gene Symbol: SLC25A48
  Gene Name: solute carrier family 25, member 48
  ENST ID: ENST00000425402
  CDS Start-End: 200-415
agccgccctccggcacttggagaggtgagcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggaggcagcctccaacacgtttccctgggctgtgtctcctctgttcttcctacagctcaagagcttaacttaacacacaccccttcccaccacctgaaaaggtgctgccccaggatagaccagacttccatgtctggtgtccaaggtaatacacagattcatcaccctccgcaggaactatcctgctggctcttgcttgcacgggctccttgctttcttggtgtggctcttagagtcagcagacatgggttcaaagtcagatgtagctactgtgagctggcaggatccaagcaagcagcttcatgtctcagggcctcagtttctcccagaatgatcatcccttccatgaagggcggggcatttgtgggttaatacaaaaagcactccattcaatatgtaacccatagggaagagttaaccatttctcatttgcattagtattatcagtgttgatttttttagcaccggtattaccctggagctctgagtcttttctcacatggctgccccaccccaggccctgccagatgaatctgccccatccttccaggcccagtgcagtccgctgccattcccaggatccatgtccttggcttgcttctcctgtacctctctcaaggggcttctcacacaccaccacgggcaacagctatttctatactgccccttctctgcctcttacagcaagttttctgacgtcctgttttactctctcccccaacttgggaaagatccagagttggatgacccagtgttgaggtaaataactaacatgccacatgagagggacaagatccaaaagctagatcaaagggccacactaaaagacagaactaccagaagtcactgtaaagtccagcccttagtattcaatcatggatcaatcatctctgtagaggatggggcaatccgatttgatgaaggcttctagggaaaaatgcctaagggctttagttttcaaatgcttatttttagagcacctagtatgtggtaggcacagttctaggagctggggacagagcagtaagcaaaagagaaaaagcccattctctgatcagctaatgttggcagtgagcgaacagtgagacctgtcctaaggttgcattaatagaagtacagtgggtagaataagggaggtggaggcctctgccctgaccagattgcagctggaatgttgcatccacctttggtcactacccattaagcaagaccctagtggtgccctgggaatgaagagcaggatatcatagcatgtgaggagaagctggaccctggttagtataagaagatgtgatacggaggaaacttgagttctgtctttatgttttaaggatggagaaactcaaagctttcctattctcattattttaaattccttttttaaatttttaacaagagctgctctgacagaagggtgaagcccagccctggtgcggcctcaattgtcttttgtatcttttttttcttcttcttttttttttttttttttttttttttttttagcagaaatacagtttgtgattcagccaatgagtatagagggatataaaagtgtttcaagtggatgattcatttttatttgagatgtttttgtctacttccccaaatattaatgtgtcataattcgtaaaaagtctgtagaggcaaaatatattgctgatattatttcctctgaaaattactgtgctcttttaaaaaaatgaagtcctggaagtcagct

SEQ ID NO: 183555 - DNA, 1148 bp, Homo sapiens
  Payload ID: 16163
  Gene Symbol: SLC25A48
  Gene Name: solute carrier family 25, member 48
  Uniprot ID: Q6ZT89
  ENST ID: ENST00000412661
  CDS Start-End: 122-595
cctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacggaggtgaacacaggatgactacagtgttccctgggcctcatctctgcatgtgaagccctgagagctgcagatgtttggcctttggacctccaagtggacatcaattagcaagcgtgggctaggatggtgcagacactgacgtggcccttctgatgcctgggatgcctcatgagtcactgattcaagccctccaaggttctgatccccaatgcccactctgctaggctggcatcaaagagctttccaagaaatgtttggtccagctgagaagtcctgaccatgagcaccagggagccagaaaccacccagagaaacgttgcttcactcctctgtctgaggatggggaggggccagtgagctctgggctcagccactccctccagtctcaagtaacacgtccccgtgcctccagtctcctctcagcaccgaccaggtttttccccgctcctgcacccgtggatcctgaggacagcggtagcgccttcctcaccgcacgctgagtccagtgcgtgctcctcactgtgcacttattagtgtctgttgagtgattaaatcacatcctcaggtctgcagcaaataaatgaaagtttctttattttttattaa

SEQ ID NO: 183556 - DNA, 587 bp, Homo sapiens
  Payload ID: 16163
  Gene Symbol: SLC25A48
  Gene Name: solute carrier family 25, member 48
  ENST ID: ENST00000462340
  CDS Start-End: 43-246
gagcttctgatttgctcattaagttaggatccgtgggacttgatgaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctact

SEQ ID NO: 183557 - DNA, 1130 bp, Homo sapiens
  Payload ID: 16164
  Gene Symbol: SLC25A51
  Gene Name: solute carrier family 25, member 51
  Uniprot ID: Q9H1U9
  ENST ID: ENST00000242275
  CDS Start-End: 231-1124
ggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaac

SEQ ID NO: 183558 - DNA, 1691 bp, Homo sapiens
  Payload ID: 16164
  Gene Symbol: SLC25A51
  Gene Name: solute carrier family 25, member 51
  Uniprot ID: Q9H1U9
  ENST ID: ENST00000377716
  CDS Start-End: 745-1638
gccccggctcgctagccgtcctgcgggacgccggcgctgatgggtgagtgtgggacgagcgtggggaagcaccgggctttcttcgcatgaggttggagggaggggaaacgcgctgaagggcccgctggggcaggctgccgccctgggggcccatccctgtcttctgcgcgctccggctgccctggcccggtccctgcgggccccacccaggcggcgcgggcggaatcagttctgagcctcctcggctccgggctcccccgcctgccgcgggtgtttgtccggctgctgggcgacctttcccgcgaaggcgctgtcccttcattcgggcgcgccctgggctggggaggcacctccctggtgcacaggaaccgcaggggcggggaggagccgggagctgcctgcgcccgggggacagcggggatggcaccgcgcaagggcctctgcgtcccgggagactgggatttcggcctcacctcgggacccctgactgtgaagtgtcagaaacggaagaggacttagtgatcttgtccaaccccctccccgcctttcacaggttggggaaatggacgcctggagaacggaaatccagttatcaaaattgactcaagaagagagaacctaacagaacaataacaatggaagaaattgggaacattatcacaaagctatcatcctgccaaactccaggctcagatgtcacaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaa

SEQ ID NO: 183559 - DNA, 1538 bp, Homo sapiens
  Payload ID: 16164
  Gene Symbol: SLC25A51
  Gene Name: solute carrier family 25, member 51
  Uniprot ID: Q9H1U9
  ENST ID: ENST00000380590
  CDS Start-End: 45-938
aggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaatgcagtttggcctcttttttttttttttttaaaggaaatcccaatcttattatggaaagccatcaactgggtgtggggagtaggtcagagggttagtgaaagtccaggggatttctcctccaagtcctaccacacaaaggaaagtctcaagcctctattcaccccttctcaatcctcacaaaatagggggttgttcaatattgtcttcaatgataaaaactttgtggttaaaagtttctccttaggactagtgacaaagttaggcttatacttttttttttttttttgaggcagagtcttgctctgttgcccaggctggagtgcagtggcacgatcttggctcactgcaacctccgcctccagggttcaagcaattctcctgccttagcctcctaagtagtcctagctactcgggaggctgaggcaggagaatctctttcttaattggccaaatataagttggtgtcgtaactccaggccacagtgagttatgggcaaagcttttttccttaagcatcaacaaaataggataaaaggttccaatagg

SEQ ID NO: 183560 - DNA, 1319 bp, Homo sapiens
  Payload ID: 16165
  Gene Symbol: SLC25A52
  Gene Name: solute carrier family 25, member 52
  ENST ID: ENST00000269205
  CDS Start-End: 190-1113
gcagtcctgcggggcgccggcggcgatgggttggggaaatggacgcctggagaacggaaatccagttatcaaaatggactcgggaagagagaacctaacagaacaataacaatggaagaaattgggaacattatcacaaagctatcatcctgccaaactccaggctcagatgatgtcacaggttaaaaaatgcccttcatgagaaagatcttaagcaacatgatagattcagaagctcatgaaaagaggccaccaatacttacatcttcaaaacaagatatatcacctcatattacaaatgttggtgaaatgaagcattacttgtgtggctgctgtgcagccttcaacaacgtcgcaatcacatatcccattcagaaggtcctctttcggcaacagctgtatggcatcaaaacccgggatgcagtacttcagttgagaagggatggatttcgaaatttgtatcgtggaatccttcccccattgatgcagaagacaactacgcttgcacttatgtttggtctgtatgaggatttatcctgccttctccggaagcatgtccgtgctccagagtttgcaacccatggcgtggcggcagtgcttgcagggacagcagaagcaattttcactccactggaaagagttcagacattgcttcaaaaccacaagcatcatgacaaatttaccaacacttatcaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatttggtcaatgattttatcggtggaggtctattgggtgccatgttgggattcttgtgttttccaattaatgttgtaaaaactcgcctacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaatttatatgaaaaaaaaccatcagttaagtgccatttatcaactgaatagaccttctaagaagaatgcagtttggcctctttcttaattggccaaatacaagttcgtgtcataactccaggccacagtgagttacgggcaaagctgttttccttaagcatcaacaaaacagaataaaaggttccaataggaaaatgtaagggtttttttttgtttt

SEQ ID NO: 183561 - DNA, 6225 bp, Homo sapiens
  Payload ID: 16166
  Gene Symbol: SLC25A53
  Gene Name: solute carrier family 25, member 53
  Uniprot ID: Q5H9E4
  ENST ID: ENST00000594199
  CDS Start-End: 182-1105
ggaagcaaagaggattgtgggagctccgttgtgcgtcgcttaagtgagggcggcggatgggcgaaggtccggtgactgcgactgtcgctgctttctgaggccacaggaaaggggccgtcggtcgccgccatgacagcgagcgaggcggagtttcttccatctgcacccagttgtcttcagcatgggggagcagaaccactctcccgggaaggagcttcagcacaggacgcgagcagaggctccaggaaagaaaagctggcattcccaggcctatgcccttggggccgtttccaactttatgtctacttttctgacctttcctatctataaggttgtgttccggcaacagatccatgccatggcagtgtcagaggctgtgagacagctttggcatgaaggtcctcaatacttctaccggggaatctaccctcctcttctctccaagacgttgcaagggactcttctgtttgggacttatgatagcctgctgtgctttctctctcctgttgggccacacaccctgggacaccgctgggctgccgggctcatgtctggcgtggtggaggccgtggcactcagcccctttgaaagggtgcaaaatgtgctccaggatggtcgcaagcaagctcgcttccccagcaccttcagcattctcaaggaattcaattcttatgggctttgggggcggctgtcactgggctactatcgtggtttctggcctgtcctggccaggaacagcctggggagtgctctatatttttctttcaaggaccccatccaggatggcctggcagagcaaggcctgccccactgggttcctgccttggtgtctggtagtgtcaatggaacaatcacctgcctagttctgtatcctctgattgtgctggttgctaatatgcagtcccatattggatggcagaacatgccaagcctgtgggcctctgcccaggatgtatggaacactcggggccgaaagctgctcctgatctaccgtggaggctccctagtcatcctaaggtccagtgtgacatggggcctcactacggcaatccatgacttcctgcagaggaagtcgcactccaggaaagagctgaagactgactagctgcagaaagtgtggcatggcagctttgttattctaaatcttccctggttggttctatatagcttacttctttggctaggttgcctaatacagccatcctttagcatctataaactcattgcatgggagaagttcccaactaccaacctgttgagcaaggacaaagcccaaaagtattccttagtcaaaaagaaacgttcaccccagtctctccacagtttcagtagcctcagagccaggaggcctttaaataacatgtaacccagattaagtgtcattcctttaaggaattccttggcaataaacagaaacttaaaaagatgaccttacttaggcactctgagctctgggacccctctaggtgtcctccagaccaaactgagtggaactccaatttcaaagaactatgcttgactcttaggatgggaattccataaaacttctcagatggctacattttcatgatattgttcactgcctctaccaccacctctcacttctcaaggctgtgggtcctactttcagggtagcagctgtggctggaaatcctaaattaggcttgcatgaactcgtcaggtgccacaagaactagtggggctggagatgggagtgagaagaggcgtggcccatggatggaaagaataaaaactttgaaagaaaagatttaattacatgcaaaatagaaacatttgctatagtctgcttggtgttatctgctaggacatttctgagagcaaggtgataacattgcctagaaaccgtttgagtttccctaagaaacctggaagtgaagtgaccatatctcttcacagaaaattgcatattttgttgatgtggttaaatgtagttactatgacataaagatcagaaatcttagcctgtcattcagagccattcaaaatatggtcatcatataactttcaacatattgtcactccacttacataaaccccaaacactagccataatgaactattgttctctccccagacattccatgaactttcccatggccatactctggcccacactattctttccacctgcagtgctccttcttcacatgccagtctaccaaaatccttccagttccttgaagcccagctcagaggtcaccttctctatggagttcttgattttccccaactgaatgtgacattagtctctgtgatgcccctttcttttttttttttttgagacggagtttcgctcttgttgcccaggctggagtgccaatggtgtgatctcagctcactgcaacctccacctcccggattcaagtgattctcctgcctcagcctcccgagtagctggaattacaggcgcccaccaccatgcctggctaattttgtatttttagtagagatggggtctctccatgttggtcaggctggtctcgaactcccaacctcatcaggtgatccacccacctcggtctcccaaagtgctgggattacaggcgtgagccaccgcgcccagcctctgtgatgcccctttctaacagcacttcatacagggtactgattccattatgtcactaatctcatgtgaccctttgttcttgtattcttcaatacctcctactagactgtaaaactcattgaaagcagggatttttgtatgcattttaaaatcttccattgtgcctaggtgctcaataacgttggtcaaattactgagttgattatcaagctgtgatatggtatatcctcagggtgctgtcccttgtacatgacgataaagttattgactcactgtcagcaagacacgtgcctttgggctgtgtttttgctttcttttaataattgatttagttttgtgctaatgataatgatgctgctactgataataataataacaataataaaaattactttcaactggcacatttgatgagtttatattactgatggcatgtttgctattagcaccagttcaggaactgaaatttcacaaacagaatcacactgtacaactgtaccatttgtttcaactctggaattttgaggatttccaagatgacatgtgttatagtttccccctacagatatcttagtaatgccctcctcttgcatctccttactgaaccaaatttgtcctgtatttgtcttacttggttgtagatttagcagtgagaacttctcactgaatgccacagaaattaaagacatggttgttggaggtatgatgtcagagagcatttgccaccaaggttggcagaaaatggctggtccaggagagctgaagatgagcttccacatctgcagatcgggatgtgttgggacagtactcaacttgtggattcaaggaagtatgaacacagagtctgcataaggaaaggaaaaagatgcattcatctcccaagtacactggtgatttccacttatgtcattctgtccatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactatctgagagttgcatacatcagttttcaatattcctagattcaatgtttgtagatccaaattattttttaagagaccgtgttttatctctgacaatgggacagttattacagaatataataaaatgaaaactcacacaatatatgtgatattgtgaaatatatacttggtctttgatcctgtttcttggcatacaactcctaaaatccttagaatttccaaagtgatatctttttgtatgctaataattgactgatggctggcagcctctggttgcttcaggatgggaactagtcaccaggaagaccaaggcaccattagagggttgggacttaacagcctcattcccgacctccagggaggggagagggatggaaggttaagttgatcaccagtggccaatgatttaatcaatcatgcctacgcaatgaagcttccataaaaaccccaaagcactgggtttggagagcttccagatagctgaacatgtggaggttcctggagggtggtgacccagggagggcacagaagctctgagccccttccgcagtacctcaccctatgcatctcttcatctctatcctttgatatatcctttataataaagtggtaaacgttaagtatttccccaagttctgtgaccctttctggcaaattaaacccaaagaaggggtcatgtgaactcaaacttgaagcccatctgtcagaagttctggaggcttggatttgcgactggtgtctgaagggcctgggaacagtcttgtgaaacctagtcctcagcttgtgggatatgacgctatctccaggtagattgtgtcagaatggaattggagtacacccagctggtgttcgctgcagaactgattgctcacttagtgtgtgggaaaactccacacatctggacatggaaatattctgtgctgattgccgtggtgtaagagcaatgcaaaaagtttgggtattttcccctcggagtatattttaaagctaaattgctaataattgcttaaatttactatatttgcctttataaaaactttatgtatgttgaagcttgaagctatgcaattataatataaacatggatttacaactaaagcatgttataatttaaataattgagtttttcaaatcggttcatatgaaatcctaggcaatattgtaaaattatacagacctgtcaactttttccacttaaaagttgtgagcaaaatttaagggcatagtcgttttcaagtaattttaaatgtcaatgttaatatttagtttagtgatgttaatggagctatgttttctgatattaaaaatgagttttaggagttgagaccaataaaataaggaggtaataaatatctatatctgtttaaacacataaaatatacaatttaacactaaaattacttggtataaaaagtcaaaaaaaagaataaaaagccatcatacaacacaatatatgcgtgatatatatttttctctaaatataaactacatcagcttttataaagctcaagttgaaataataacgttttatgacaaatcattatatggtatattctgacttaattttgcatttacaatttatttttaaacactaaatagcattataattttactgggataactatatatagtgtagtatattaaagttaataaaatgacgttgcatatgagagaaaaagcataataaatcagaaacaatataaaaagctttcagaaaagataaaaatattgtatttctctagtctgttcactctccagtgtctctggttctttcatatcatcttcctttcctcaaatcttttaatactccctccctcatcatttccaactagtgaccctactttctatttcattaagaaaacagatacattcagaagagaactgccagtttaaagaacatttacaaagccatcacccatgtaataaccagccagagcaagaaatagagccctttaataacctactcttctccccccaccactgatgacaccgctccctccatcttaggtgtagcccccatgctgacttttgtaataataatttctttgcttttgtttataagttttcttccttataagcatctctaaacaacagttttgttttacagatgttcaaacattaaatgctttttagacttggaattgtgactatcttgtttcactccacattgcttgtgagactcattgatattgcagatagctgtagttgatccatttttattgttgtacagtttaccattgtataaatataccatgatttattcatgataactttgaggaacattctggttgtttgcaggttttatttttacagttcattagttttattgatgtataataattgtatatgtttatggggtatatgtgatattttgatacatgtgtacaatgtgtaatgattaaatcaaggtaattgggatatccatcagctcaaacatttatcatttctttgcattgggaacattccaaatcttctcttctagctattttgaaatacacaataaattgaatactgtggtca

SEQ ID NO: 183562 - DNA, 3660 bp, Homo sapiens
  Payload ID: 16167
  Gene Symbol: SLC26A1
  Gene Name: solute carrier family 26 (anion exchanger), member 1
  Uniprot ID: Q9H2B4
  ENST ID: ENST00000361661
  CDS Start-End: 379-2484
accactgcctgcaggttggcgccaccacccccactctccccgctgctcgcgggagccagagggccctgcggtcctcggtggtcttgccagcccctcgtcatcccagggccctccgcgcctgtgaggactccctcagcgtgcaaacagcaggctcagcccaggctccagggtgtcctgggcacctggtgtcctgggagcaaagtctttgcctaacgtcgctgagaagaatgtttaaagtgaaagtacattggagtctgcaaacaggacagacccgaggcctcacgtgggaccagtcaggcctctaagcaccgcctccctaacgccacggtgttttccgagatcaagggaaaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtgggacctcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgtgcctctgtaaggggctctgggacgcccagaccctgcccgccgcccacctggtggtgacaagctccagcagccagtgggtccggacctgcttgatgccgcggtgagggacggcgcccacataggcgaggttgagctgctggtcccagctgaggacgtactggtcagcctggctgtgtggcagcggggggctggggacaacaaaggggcggctcagtcccgagcctcagcatggctggcagcgcggctgacacacacgttcaagcccaggactgcccgggcgcaggatccaggcgctgcccgtgcgttcagtgactaataaaatgacccttagggccaggaa

SEQ ID NO: 183563 - DNA, 3109 bp, Homo sapiens
  Payload ID: 16167
  Gene Symbol: SLC26A1
  Gene Name: solute carrier family 26 (anion exchanger), member 1
  Uniprot ID: Q9H2B4
  ENST ID: ENST00000398516
  CDS Start-End: 168-2273
acagaccactgcctgcaggttggcgccaccacccccactctccccgctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtgggacctcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgt

SEQ ID NO: 183564 - DNA, 1111 bp, Homo sapiens
  Payload ID: 16167
  Gene Symbol: SLC26A1
  Gene Name: solute carrier family 26 (anion exchanger), member 1
  Uniprot ID: Q9H2B4
  ENST ID: ENST00000398520
  CDS Start-End: 104-778
gggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccagacgtcctggggtagaaacagcttccagcaacacccatggcaattaacacagaggagtgactcgcaggaacttctggaagaggaggaaagatcttgctgatttaacaggaaatgccgacatcaacgacatcgagaatgcgggaccctcacaccagcctcacgagaagccggtggatacagcttattccagagggaggcttggatcagcacctggggaaaaaaggcagcccctcaacctggccagcctgcagaggagagaagcctgagcaagcgtcctccaaatttcacaacaggctttaccatgtggatgatgtaaccagtcatcagtacatttctgtaaagcaaagcacacttttaaaaaccagccatgctagtgggcctgaggattacctttcgtcttcctctttcctctgtggaagatgatattgcaaaa

SEQ ID NO: 183565 - DNA, 1057 bp, Homo sapiens
  Payload ID: 16167
  Gene Symbol: SLC26A1
  Gene Name: solute carrier family 26 (anion exchanger), member 1
  Uniprot ID: Q9H2B4
  ENST ID: ENST00000622731
  CDS Start-End: 383-1057
acagaccactgcctgcaggttggcgccaccacccccactctccccgctgctcgcgggagccagagggccctgcggtcctcggtggtcttgccagcccctcgtcatcccagggccctccgcgcctgtgaggactccctcagcgtgcaaacagcaggctcagcccaggctccagggtgtcctgggcacctggtgtcctgggagcaaagtctttgcctaacgtcgctgagaagaatgtttaaagtgaaagtacattggagtctgcaaacaggacagacccgaggcctcacgtgggaccagtcaggcctctaagcaccgcctccctaacgccacggtgttttccgagatcaagggaaaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccagacgtcctggggtagaaacagcttccagcaacacccatggcaattaacacagaggagtgactcgcaggaacttctggaagaggaggaaagatcttgctga

SEQ ID NO: 183566 - DNA, 2885 bp, Homo sapiens
  Payload ID: 16168
  Gene Symbol: SLC26A11
  Gene Name: solute carrier family 26 (anion exchanger), member 11
  Uniprot ID: Q86WA9
  ENST ID: ENST00000361193
  CDS Start-End: 281-2101
tccccggcgattcctgcggacccagctgcggcgacgccaggagaccccaagctgcatcgccgagtggaagcaactagaactccagggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaa

SEQ ID NO: 183567 - DNA, 2872 bp, Homo sapiens
  Payload ID: 16168
  Gene Symbol: SLC26A11
  Gene Name: solute carrier family 26 (anion exchanger), member 11
  Uniprot ID: Q86WA9
  ENST ID: ENST00000411502
  CDS Start-End: 270-2090
gattcctgcggacccagctgcggcgacgccaggagaccccaagctgcatcgccgagtggcaactagaactccagggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatac

SEQ ID NO: 183568 - DNA, 2807 bp, Homo sapiens
  Payload ID: 16168
  Gene Symbol: SLC26A11
  Gene Name: solute carrier family 26 (anion exchanger), member 11
  Uniprot ID: Q86WA9
  ENST ID: ENST00000546047
  CDS Start-End: 203-2023
gattcctgcggacccagctgcggcgacgccaggagaccccaagctgcatcgccgagtggagccgttcgcccccctggggaggggagacccatagtgacctctcctgacacccgccgaccctgaccagtgttgccgggttcttcaaaggccacgctctgactgctggtctgtgtcacctgcaccccccagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaa

SEQ ID NO: 183569 - DNA, 591 bp, Homo sapiens
  Payload ID: 16168
  Gene Symbol: SLC26A11
  Gene Name: solute carrier family 26 (anion exchanger), member 11
  ENST ID: ENST00000571215
  CDS Start-End: 1-591
ctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggggcgcttctcctgttttggactccagctgaggatgaatttaccgtgttcctcccagcacctggcgcctcttcagacaaggaggcggatcctgcagctgacaagcacttgctcctgttacctgtggggcggggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggc

SEQ ID NO: 183570 - DNA, 762 bp, Homo sapiens
  Payload ID: 16168
  Gene Symbol: SLC26A11
  Gene Name: solute carrier family 26 (anion exchanger), member 11
  ENST ID: ENST00000577155
  CDS Start-End: 304-762
agcacggtgcttgctctggaggaacctggggtttctgagagggactggggttgggggagacggtggtgggtgggtggtggagggctgtgcccttgggataagggaaaagacagctgagacacaggctctggggtcggaaatgagagccaggagggcaccctgtctgcagtctctggggaccggagcaccagcccctcctctgggatcccctcccaagagggatttgagatccgtggacccctgagccctggctgggcagggtcagaggagggtgggacaggcggcacgagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtc

SEQ ID NO: 183571 - DNA, 845 bp, Homo sapiens
  Payload ID: 16168
  Gene Symbol: SLC26A11
  Gene Name: solute carrier family 26 (anion exchanger), member 11
  ENST ID: ENST00000571176
  CDS Start-End: 216-845
gatgagggacggggtgggccttccagtcttggcccagtccccatcttgcacacattgttggcttcctcttagagccgttcgcccccctggggaggggagacccatagtgacctctcctgacacccgccgaccctgaccagtgttgccgggttcttcaaaggccacgctctgactgctggtctgtgtcacctgcaccccccagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctg

SEQ ID NO: 183572 - DNA, 492 bp, Homo sapiens
  Payload ID: 16168
  Gene Symbol: SLC26A11
  Gene Name: solute carrier family 26 (anion exchanger), member 11
  ENST ID: ENST00000575019
  CDS Start-End: 1-176
ctctgctcatgctcctgcactctgcagccaggcctgagaccaaggtgtcagaggggccggttctggtcctgcagccggccagcggcctgtccttccctgccatggaggctctgcgggaggagatcctaagccgggccctggaaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactg

SEQ ID NO: 183573 - DNA, 472 bp, Homo sapiens
  Payload ID: 16168
  Gene Symbol: SLC26A11
  Gene Name: solute carrier family 26 (anion exchanger), member 11
  ENST ID: ENST00000576126
  CDS Start-End: 73-472
gattcctgcggacccagctgcggcgacgccaggagaccccaagctgcatcgccgagtggccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccag

SEQ ID NO: 183574 - DNA, 1862 bp, Homo sapiens
  Payload ID: 16168
  Gene Symbol: SLC26A11
  Gene Name: solute carrier family 26 (anion exchanger), member 11
  Uniprot ID: Q86WA9
  ENST ID: ENST00000572725
  CDS Start-End: 42-1862
ggagaccccaagctgcatcgccgagtggccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataa

SEQ ID NO: 183575 - DNA, 523 bp, Homo sapiens
  Payload ID: 16168
  Gene Symbol: SLC26A11
  Gene Name: solute carrier family 26 (anion exchanger), member 11
  ENST ID: ENST00000573809
  CDS Start-End: 331-523
ctgtccccggcgattcctgcggacccagctgcggcgacgccaggagaccccaagctgcatcgccgagtggaagcaactagaactccagggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcattt

SEQ ID NO: 183576 - DNA, 547 bp, Homo sapiens
  Payload ID: 16168
  Gene Symbol: SLC26A11
  Gene Name: solute carrier family 26 (anion exchanger), member 11
  ENST ID: ENST00000574967
  CDS Start-End: 315-547
gattcctgcggacccagctgcggcgacgccaggagaccccaagctgcatcgccgagtggaagcaactagaactccagggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacggccacgctctgactgctggtctgtgtcacctgcaccccccagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgcccca

SEQ ID NO: 183577 - DNA, 8080 bp, Homo sapiens
  Payload ID: 16169
  Gene Symbol: SLC26A2
  Gene Name: solute carrier family 26 (anion exchanger), member 2
  Uniprot ID: P50443
  ENST ID: ENST00000286298
  CDS Start-End: 269-2488
gtgacggcctcggccgcgggcgtttacactggctctgcctccggcatctcttcgccggtgcgtcctcgccgcgcccgtaggtcccggcagccgggccccgcctccttcggagtccgagcgatgggcggggaaagggacaggcaggtatagctctgtcggcgccgcggtgtccacctcagtcaggccacggtggaagacgcgtgccgcggcgcctggttgcctgcagcggcccggacccgagaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcaggtagcgatgggcttctttcaagtgggttttgtttctgtctacctctcagatgccttgctgagtggatttgtcactggtgcctccttcactattcttacatctcaggccaagtatcttcttgggctcaaccttcctcggactaatggtgtgggctcactcatcactacctggatacatgtcttcagaaacatccataagaccaatctctgtgatcttatcaccagccttttgtgccttttggttcttttgccaaccaaagaactcaatgaacacttcaaatccaagcttaaggcaccgattcctattgaacttgttgttgttgtagcagccacattagcctctcattttggaaaactacatgaaaattataattctagtattgctggacatattcccactgggtttatgccacccaaagtaccagaatggaacctaattcctagtgtggctgtagatgcaatagctatttccatcattggttttgctatcactgtatcactttctgagatgtttgccaagaaacatggttacacagtcaaagcaaaccaggaaatgtatgccattggcttttgtaatatcatcccttccttcttccactgttttactactagtgcagctcttgcaaagacattggttaaagaatcaacaggctgccatactcagctttctggtgtggtaacagccctggttcttttgttggtcctcctagtaatagctcctttgttctattcccttcaaaaaagtgtccttggtgtgatcacaattgtaaatctacggggagcccttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagattaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaagaaaaccttctcttctatagtgtgtatgaagcgatggcttttgcagaagtatctaaaaatcagaaaggagtatgtgttcccaatggtctgagtcttagtagtgattaattgagaaggtagatagaagaatgtctagccaataggttaaaatttcaagtgtccaacatttcccagttccacagtgggaaattttgcacacttgaaattttaaccaagtggctagatattattcctcctttgaagctaatggcatttgtatatacacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttagaagtcacattcataaaacccaagtgctatgggtgtattattcatgatagctggcccacaggtcatgaattgaggaggaatttgctttcaaaaagcaagaatgtccaacactgaaagtttatagttttatatttggaccttgaaaggtaagaaaaaaccaggttctccaaagttaggaatagggaactaatttatgaaacagccatcttaaaaaaaaaaaaagtaaactgcaaaagtacaaaatcatttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcagcctcccagagtgttgggattacaggcgtgagccactgcacttggccaagttatttatttttaatctctcttgcccttctcccaaggcaggcttaagttgagactattataggtgtctaataacctgtgacagagtaatgagtacatgcttaagatgttataattagccaacaccaacacagcaaaaaatataattccagccaaagattctggaaaatccctcagaaggagggataacaggatttgacctttaccagcgatttctgtccatatgtggatgtaaacagttctggaacgttatgcatgcagttagcgaatccttgaattatgttctggtttgtacttgtcccatccatccaaacaagagattctgcttttggtagccatctgtagaaacatttaagatgtcactagaatttacatttcatcctctctacttgggttgaggttgcctatacttgcatattgttaaaatgttttggttgctgatattcagaggaatgaaacctggaaccaaagcctaatttgccgataaaaaaactgttttcggccaggtgcagtggctcatgcctgtaatcccagcacgttgggaggccgaggcgggtggatcacctgaagtcaggagttcgagaccatcctggctaacactgtgaaaccccgtctctactaaaaatacaaaaaattagcggggcatggtggcacgcgcctgtagtcccagctactcaggaggctgaggcaggagaattacttgaacccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggctgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggtttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttgatgtaattccatgtaaatcattgcttaaccctcttatgggatgaggatgagttattaatgtattgcagcctactggaaaggagggggagttggttaatagcagatacttttcttctagaagcttatgttttatgctgtttattatgtaagatcctgtatgtgtgttgagatttagaggtttcatttgttttgtctgctaataaattgttactctaataatacatta

SEQ ID NO: 183578 - DNA, 570 bp, Homo sapiens
  Payload ID: 16169
  Gene Symbol: SLC26A2
  Gene Name: solute carrier family 26 (anion exchanger), member 2
  ENST ID: ENST00000433184
  CDS Start-End: 501-570
tcttcgccggtgcgtcctcgccgcgcccgtaggtcccggcagccgggccccgcctccttcggagtccgagcgatgggcggggaaagggacaggcaggtatagctctgtcggcgccgcggtgtccacctcagtcaggccacggtggaagacgcgtgccgcggcgcctggttgcctgcagcggcccggacccgagaggtcagaaattgatgctgagtacagtgaagttttacaaaaccattgccatatgactgctgagcagtatagctgggatctgaacagagatctgtttgacttccagaacacatccagtgattctccaagtgtggtcctaagctcactcgttcagcatcatctagcgtgtggagtcctggatctcatccttggatttgcagggatggtcctaagaagctaacggctctctgtatttgacaattattgtactgtaatgtgctgcctcctaggggaagatctagaggaagctgaaccatctatctccagaaatgtcttcagaaagtaaagagcaacataacgtttcacccagagactcagctgaaggaaatgacagttatc

SEQ ID NO: 183579 - DNA, 618 bp, Homo sapiens
  Payload ID: 16169
  Gene Symbol: SLC26A2
  Gene Name: solute carrier family 26 (anion exchanger), member 2
  ENST ID: ENST00000503336
  CDS Start-End: 1-375
ggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcagtgattgttttgttaatgtggaagcaacattttctatgattaatctgctgttacctgttttgactgagctactacaaaaagaaaaatcactgaattgctatgggtttctgaaatatccaaaaaattaacctgaagcagggggaaaaatgacatcacaccattagcaggtattgtgtgaaacttctaaaaatgaaactgacatttatctgacttattaggaataaatactctctaatgaactctctaa

SEQ ID NO: 183580 - DNA, 2863 bp, Homo sapiens
  Payload ID: 16170
  Gene Symbol: SLC26A3
  Gene Name: solute carrier family 26 (anion exchanger), member 3
  Uniprot ID: P40879
  ENST ID: ENST00000340010
  CDS Start-End: 186-2480
cctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattcttgacttttcagcagtgtcctttcttgatgtttcttcagtgaggggccttaaatcgattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtaca

SEQ ID NO: 183581 - DNA, 2602 bp, Homo sapiens
  Payload ID: 16170
  Gene Symbol: SLC26A3
  Gene Name: solute carrier family 26 (anion exchanger), member 3
  ENST ID: ENST00000379083
  CDS Start-End: 204-362
gcacacagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtacagtgga

SEQ ID NO: 183582 - DNA, 552 bp, Homo sapiens
  Payload ID: 16170
  Gene Symbol: SLC26A3
  Gene Name: solute carrier family 26 (anion exchanger), member 3
  ENST ID: ENST00000453332
  CDS Start-End: 193-552
gcacacagagcctgtagacctgagtggatggacactgcctcttagaactagaacttagaactttatcttgaaaatgtaccactgttgcagaagctcctcacagagcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggc

SEQ ID NO: 183583 - DNA, 4930 bp, Homo sapiens
  Payload ID: 16171
  Gene Symbol: SLC26A4
  Gene Name: solute carrier family 26 (anion exchanger), member 4
  Uniprot ID: O43511
  ENST ID: ENST00000265715
  CDS Start-End: 225-2567
ctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttggaacatcaagacatatctcagttggaccttttccagtggtgagtttaatggtgggatctgttgttctgagcatggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaaccaaaaactacaatggagttctctctattatctatacgctggttgagatttttcaaaatattggtgataccaatcttgctgatttcactgctggattgctcaccattgtcgtctgtatggcagttaaggaattaaatgatcggtttagacacaaaatcccagtccctattcctatagaagtaattgtgacgataattgctactgccatttcatatggagccaacctggaaaaaaattacaatgctggcattgttaaatccatcccaagggggtttttgcctcctgaacttccacctgtgagcttgttctcggagatgctggctgcatcattttccatcgctgtggtggcttatgctattgcagtgtcagtaggaaaagtatatgccaccaagtatgattacaccatcgatgggaaccaggaattcattgcctttgggatcagcaacatcttctcaggattcttctcttgttttgtggccaccactgctctttcccgcacggccgtccaggagagcactggaggaaagacacaggttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaa

SEQ ID NO: 183584 - DNA, 600 bp, Homo sapiens
  Payload ID: 16171
  Gene Symbol: SLC26A4
  Gene Name: solute carrier family 26 (anion exchanger), member 4
  ENST ID: ENST00000440056
  CDS Start-End: 208-600
aggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttgga

SEQ ID NO: 183585 - DNA, 2689 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000306312
  CDS Start-End: 263-2497
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 183586 - DNA, 2474 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000339444
  CDS Start-End: 237-2294
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 183587 - DNA, 2686 bp, Homo sapiens
  Payload ID: 16172
  Gene Symbol: SLC26A5
  Gene Name: solute carrier family 26 (anion exchanger), member 5
  ENST ID: ENST00000354356
  CDS Start-End: 263-2503
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttc

SEQ ID NO: 183588 - DNA, 1404 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000356767
  CDS Start-End: 237-1244
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctaggctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 183589 - DNA, 2174 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000393723
  CDS Start-End: 9-2153
agagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggat

SEQ ID NO: 183590 - DNA, 2270 bp, Homo sapiens
  Payload ID: 16172
  Gene Symbol: SLC26A5
  Gene Name: solute carrier family 26 (anion exchanger), member 5
  ENST ID: ENST00000393727
  CDS Start-End: 9-2249
agagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggat

SEQ ID NO: 183591 - DNA, 2422 bp, Homo sapiens
  Payload ID: 16172
  Gene Symbol: SLC26A5
  Gene Name: solute carrier family 26 (anion exchanger), member 5
  ENST ID: ENST00000393729
  CDS Start-End: 166-2289
tcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaa

SEQ ID NO: 183592 - DNA, 2498 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000393730
  CDS Start-End: 168-2306
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 183593 - DNA, 1947 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000393735
  CDS Start-End: 237-1787
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 183594 - DNA, 2374 bp, Homo sapiens
  Payload ID: 16172
  Gene Symbol: SLC26A5
  Gene Name: solute carrier family 26 (anion exchanger), member 5
  ENST ID: ENST00000423416
  CDS Start-End: 168-1589
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacg

SEQ ID NO: 183595 - DNA, 2588 bp, Homo sapiens
  Payload ID: 16172
  Gene Symbol: SLC26A5
  Gene Name: solute carrier family 26 (anion exchanger), member 5
  Uniprot ID: P58743
  ENST ID: ENST00000432958
  CDS Start-End: 263-2401
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaag

SEQ ID NO: 183596 - DNA, 2370 bp, Homo sapiens
  Payload ID: 16172
  Gene Symbol: SLC26A5
  Gene Name: solute carrier family 26 (anion exchanger), member 5
  ENST ID: ENST00000456463
  CDS Start-End: 166-801
tcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatgcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaa

SEQ ID NO: 183597 - DNA, 2324 bp, Homo sapiens
  Payload ID: 16172
  Gene Symbol: SLC26A5
  Gene Name: solute carrier family 26 (anion exchanger), member 5
  ENST ID: ENST00000445809
  CDS Start-End: 168-914
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatgcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 183598 - DNA, 2242 bp, Homo sapiens
  Payload ID: 16172
  Gene Symbol: SLC26A5
  Gene Name: solute carrier family 26 (anion exchanger), member 5
  ENST ID: ENST00000454864
  CDS Start-End: 168-1511
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 183599 - DNA, 2586 bp, Homo sapiens
  Payload ID: 16173
  Gene Symbol: SLC26A6
  Gene Name: solute carrier family 26 (anion exchanger), member 6
  ENST ID: ENST00000307364
  CDS Start-End: 62-424
ggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcaggatctgctctccaggcctgcactgctaccattctacccctaggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 183600 - DNA, 2317 bp, Homo sapiens
  Payload ID: 16173
  Gene Symbol: SLC26A6
  Gene Name: solute carrier family 26 (anion exchanger), member 6
  ENST ID: ENST00000337000
  CDS Start-End: 101-2056
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 183601 - DNA, 2729 bp, Homo sapiens
  Payload ID: 16173
  Gene Symbol: SLC26A6
  Gene Name: solute carrier family 26 (anion exchanger), member 6
  ENST ID: ENST00000358747
  CDS Start-End: 252-2468
aaagaggctttctcaccagccaaagttcaggtactgcccctgtctgagtttggacatgtggcccacagatgccagctgggggctggaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 183602 - DNA, 2545 bp, Homo sapiens
  Payload ID: 16173
  Gene Symbol: SLC26A6
  Gene Name: solute carrier family 26 (anion exchanger), member 6
  Uniprot ID: Q9BXS9
  ENST ID: ENST00000383733
  CDS Start-End: 62-2284
ggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 183603 - DNA, 2589 bp, Homo sapiens
  Payload ID: 16173
  Gene Symbol: SLC26A6
  Gene Name: solute carrier family 26 (anion exchanger), member 6
  Uniprot ID: Q9BXS9
  ENST ID: ENST00000395550
  CDS Start-End: 49-2328
ctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 183604 - DNA, 556 bp, Homo sapiens
  Payload ID: 16173
  Gene Symbol: SLC26A6
  Gene Name: solute carrier family 26 (anion exchanger), member 6
  ENST ID: ENST00000431213
  CDS Start-End: 1-267
gctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtgggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcact

SEQ ID NO: 183605 - DNA, 724 bp, Homo sapiens
  Payload ID: 16173
  Gene Symbol: SLC26A6
  Gene Name: solute carrier family 26 (anion exchanger), member 6
  ENST ID: ENST00000414944
  CDS Start-End: 1-583
aggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctattgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttgg

SEQ ID NO: 183606 - DNA, 910 bp, Homo sapiens
  Payload ID: 16173
  Gene Symbol: SLC26A6
  Gene Name: solute carrier family 26 (anion exchanger), member 6
  ENST ID: ENST00000421649
  CDS Start-End: 1-910
ggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaagctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttg

SEQ ID NO: 183607 - DNA, 2460 bp, Homo sapiens
  Payload ID: 16173
  Gene Symbol: SLC26A6
  Gene Name: solute carrier family 26 (anion exchanger), member 6
  Uniprot ID: Q9BXS9
  ENST ID: ENST00000455886
  CDS Start-End: 49-2220
ctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggcaaccccaggacccctgcctctcctgactgcccctggccgccccacaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctattgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctca

SEQ ID NO: 183608 - DNA, 588 bp, Homo sapiens
  Payload ID: 16173
  Gene Symbol: SLC26A6
  Gene Name: solute carrier family 26 (anion exchanger), member 6
  ENST ID: ENST00000431739
  CDS Start-End: 49-588
ctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtgggtggggctgggcctgatccacttcggcttcgtggtcacctacctgtcagaacctcttgtccgaggctataccacagctgcagctgtgcaggtcttcgtctcacagct

SEQ ID NO: 183609 - DNA, 806 bp, Homo sapiens
  Payload ID: 16173
  Gene Symbol: SLC26A6
  Gene Name: solute carrier family 26 (anion exchanger), member 6
  ENST ID: ENST00000444531
  CDS Start-End: 1-654
gccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcaggtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttcc

SEQ ID NO: 183610 - DNA, 2630 bp, Homo sapiens
  Payload ID: 16173
  Gene Symbol: SLC26A6
  Gene Name: solute carrier family 26 (anion exchanger), member 6
  Uniprot ID: Q9BXS9
  ENST ID: ENST00000420764
  CDS Start-End: 91-2367
ggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaa

SEQ ID NO: 183611 - DNA, 555 bp, Homo sapiens
  Payload ID: 16173
  Gene Symbol: SLC26A6
  Gene Name: solute carrier family 26 (anion exchanger), member 6
  ENST ID: ENST00000426599
  CDS Start-End: 49-555
ctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggcaaccccaggacccctgcctctcctgactgcccctggccgccccacaggtggggctgggcctgatccacttcgg

SEQ ID NO: 183612 - DNA, 2623 bp, Homo sapiens
  Payload ID: 16173
  Gene Symbol: SLC26A6
  Gene Name: solute carrier family 26 (anion exchanger), member 6
  ENST ID: ENST00000614797
  CDS Start-End: 101-2362
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcaggatctgctctccaggctgcactgctaccattctaccctaggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 183613 - DNA, 5263 bp, Homo sapiens
  Payload ID: 16174
  Gene Symbol: SLC26A7
  Gene Name: solute carrier family 26 (anion exchanger), member 7
  Uniprot ID: Q8TE54
  ENST ID: ENST00000276609
  CDS Start-End: 240-2210
gaatataaggggaattactggcgagagagctgtagaccaacttaacactgaacccattacttttccaagaccagaaaaaaatattacatgaacaggaactacttctccttcagataagaattcaagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcactttctaatttattagagattatggatcagttctgacattaaaatcatagttaattgatggatggtttttatagtttgttgataaagtggacacagtattgtctgagcagttatattttaatgcatttcagtgtttatagtagaagtttagtggataaaactttaagtccaataacttgggggtcaaatgctaatgttttattcaatgtaaaggaagaccaaaccatgtaccttatgaagacctttgttttaagacttccacacaccaaggctacaatgactgttaacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttcaccatttgtctttcattttaaaggttatttgctcccgattatatgattcaagtgttataagttttagcttgaactactttgcagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgc

SEQ ID NO: 183614 - DNA, 2656 bp, Homo sapiens
  Payload ID: 16174
  Gene Symbol: SLC26A7
  Gene Name: solute carrier family 26 (anion exchanger), member 7
  Uniprot ID: Q8TE54
  ENST ID: ENST00000309536
  CDS Start-End: 221-2212
ggcgagagagctgtagaccaacttaacactgaacccattacttttccaagaccagaaaaaaatattacatgaacaggaactacttctccttcagataagaattcaagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataaggccagttataaactgttgtttgataacttggatcttccaacaatgccaccgctctgaggattgggtggttgcctatcatttgcaaactgcttacttgtacaacaaatgcttcttccaggatctactgtcctggggacttgaatccacctttctcaaatataaaaactctaaatatggccttttaagttttttctgctctgatatcttgcctctaagcttatattgccatctttggaaatactatttgtagaatctagtgctcacatgatctgaagtgtcaaagttattttacaaatgctgggcttatggtttagttttacaactgttcttagagctttaatttcctgcaatttttccttgagttttgaattgttttgcctttcctcacccctagaataacatttggtgcctcgcagagtcatccctattgtatacaatcagaacagtatgtatttacaaaataataataacactattattattaaatctaacatatattga

SEQ ID NO: 183615 - DNA, 2638 bp, Homo sapiens
  Payload ID: 16174
  Gene Symbol: SLC26A7
  Gene Name: solute carrier family 26 (anion exchanger), member 7
  ENST ID: ENST00000522181
  CDS Start-End: 199-1008
gtgaagccagcaagtcttgactaatctccaagcaatgtagctgtaaaaggactggaagataagcaagaatctgaagctggtgcctctccaagtattaatttgttcttacaaatgttttactcaacgtgaccctaacctctttggaattgctcaggtgtagaacagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaa

SEQ ID NO: 183616 - DNA, 736 bp, Homo sapiens
  Payload ID: 16174
  Gene Symbol: SLC26A7
  Gene Name: solute carrier family 26 (anion exchanger), member 7
  ENST ID: ENST00000520818
  CDS Start-End: 1-713
gcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggtggagtgtgcccccagtccctctccactccagttgtatcattgcactgtgcactcccagatcctaaaaatgatgaacttatgaaaaataaaactttcctaactgta

SEQ ID NO: 183617 - DNA, 2902 bp, Homo sapiens
  Payload ID: 16174
  Gene Symbol: SLC26A7
  Gene Name: solute carrier family 26 (anion exchanger), member 7
  Uniprot ID: Q8TE54
  ENST ID: ENST00000523719
  CDS Start-End: 273-2243
ccagcaagtcttgactaatctccaagcaatgtagctgtaaaaggactggaagataagcaagaatctgaagctggtgcctctccaagtattaatttgttcttacaaatgttttactcaacgtgaccctaacctctttggaattgctcaggtgtagaacagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttga

SEQ ID NO: 183618 - DNA, 818 bp, Homo sapiens
  Payload ID: 16174
  Gene Symbol: SLC26A7
  Gene Name: solute carrier family 26 (anion exchanger), member 7
  ENST ID: ENST00000522862
  CDS Start-End: 198-818
tgaagccagcaagtcttgactaatctccaagcaatgtagctgtaaaaggactggaagataagcaagaatctgaagctggtgcctctccaagtattaatttgttcttacaaatgttttactcaacgtgaccctaacctctttggaattgctcaggtgtagaacagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatcc

SEQ ID NO: 183619 - DNA, 5257 bp, Homo sapiens
  Payload ID: 16174
  Gene Symbol: SLC26A7
  Gene Name: solute carrier family 26 (anion exchanger), member 7
  Uniprot ID: Q8TE54
  ENST ID: ENST00000617233
  CDS Start-End: 232-2202
aggactggaagataagcaagaatctgaagctggtgcctctccaagtattaatttgttcttacaaatgttttactcaacgtgaccctaacctctttggaattgctcaggtgtagaacagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcactttctaatttattagagattatggatcagttctgacattaaaatcatagttaattgatggatggtttttatagtttgttgataaagtggacacagtattgtctgagcagttatattttaatgcatttcagtgtttatagtagaagtttagtggataaaactttaagtccaataacttgggggtcaaatgctaatgttttattcaatgtaaaggaagaccaaaccatgtaccttatgaagacctttgttttaagacttccacacaccaaggctacaatgactgttaacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttcaccatttgtctttcattttaaaggttatttgctcccgattatatgattcaagtgttataagttttagcttgaactactttgcagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgctt

SEQ ID NO: 183620 - DNA, 5094 bp, Homo sapiens
  Payload ID: 16174
  Gene Symbol: SLC26A7
  Gene Name: solute carrier family 26 (anion exchanger), member 7
  ENST ID: ENST00000617078
  CDS Start-End: 972-2039
aggactggaagataagcaagaatctgaagctggtgcctctccaagtattaatttgttcttacaaatgttttactcaacgtgaccctaacctctttggaattgctcaggtgtagaacagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcactttctaatttattagagattatggatcagttctgacattaaaatcatagttaattgatggatggtttttatagtttgttgataaagtggacacagtattgtctgagcagttatattttaatgcatttcagtgtttatagtagaagtttagtggataaaactttaagtccaataacttgggggtcaaatgctaatgttttattcaatgtaaaggaagaccaaaccatgtaccttatgaagacctttgttttaagacttccacacaccaaggctacaatgactgttaacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttcaccatttgtctttcattttaaaggttatttgctcccgattatatgattcaagtgttataagttttagcttgaactactttgcagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgctt

SEQ ID NO: 183621 - DNA, 3463 bp, Homo sapiens
  Payload ID: 16175
  Gene Symbol: SLC26A8
  Gene Name: solute carrier family 26 (anion exchanger), member 8
  Uniprot ID: Q96RN1
  ENST ID: ENST00000355574
  CDS Start-End: 172-3084
ggtatccgcgtccgcagcgccgccagccaggcgagagccgtgtgggatcccagcgcccgcactcccgcccccgccaaggagccaggtgagccgctgctgggagacgcctgggcgccgggggctgcaggtcccagggcgggggctgcgtccgtcaccggcaggtacccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactct

SEQ ID NO: 183622 - DNA, 3144 bp, Homo sapiens
  Payload ID: 16175
  Gene Symbol: SLC26A8
  Gene Name: solute carrier family 26 (anion exchanger), member 8
  Uniprot ID: Q96RN1
  ENST ID: ENST00000394602
  CDS Start-End: 167-2764
gctgggagacgcctgggcgccgggggctgcaggtcccagggcgggggctgcgtccgtcaccggcaggtacccaggtatgccgcagagccaggcacgccgtgggcactcagtcagtatctgtggaatgaatgaatgatggtcgtccctgggagcttatctctgaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactcta

SEQ ID NO: 183623 - DNA, 3653 bp, Homo sapiens
  Payload ID: 16175
  Gene Symbol: SLC26A8
  Gene Name: solute carrier family 26 (anion exchanger), member 8
  Uniprot ID: Q96RN1
  ENST ID: ENST00000490799
  CDS Start-End: 355-3267
tgttcaggacacgaggcctggcaccaaataggccctcgatcaagaatagcaaaacctcggagagagaaggagccttggtatacaggtttaccaaataccaaggggatcccacgactcaggtatgaggagggcgacccaggtaccactttcctggctccctagcccagctgctcatgctcctcttcctcgtcccctcccccactctcatctcctcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaca

SEQ ID NO: 183624 - DNA, 2104 bp, Homo sapiens
  Payload ID: 16175
  Gene Symbol: SLC26A8
  Gene Name: solute carrier family 26 (anion exchanger), member 8
  ENST ID: ENST00000465492
  CDS Start-End: 1-961
tttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacaggtaagtactgaggaggccttggcaggagctctgatccccctcctaccatcccaaccccaccctgatcctgattgaattctgttagtcactgatcagctgctatgagactgctaggccaccagagccttggacaccaaaggcagtacaatataaggtcaatcaaaataaaaagagaatgaaccaattcttttttcttttttcttttttgagatggagcctcactctgttgcccaggctggagtgcagtggcacaatcttggctcactgcaacctccacctcccaggttcaagagattctcctgcctcagcctcctgaatagctggaactacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctg

SEQ ID NO: 183625 - DNA, 740 bp, Homo sapiens
  Payload ID: 16175
  Gene Symbol: SLC26A8
  Gene Name: solute carrier family 26 (anion exchanger), member 8
  ENST ID: ENST00000469847
  CDS Start-End: 1-554
tggtatacaggtttaccaaataccaaggggatcccacgactcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggtgagccgctgctgggagacgcctgggcgccgggggctgcaggtcccagggcgggggctgcgtccgtcaccggcaggtacccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatc

SEQ ID NO: 183626 - DNA, 582 bp, Homo sapiens
  Payload ID: 16175
  Gene Symbol: SLC26A8
  Gene Name: solute carrier family 26 (anion exchanger), member 8
  ENST ID: ENST00000480663
  CDS Start-End: 13-582
gtgcactgctgtatgttcaggacacgaggcctggcaccaaataggccctcgatcaagaatagcaaaacctcggagagagaaggagccttggtatacaggtttaccaaataccaaggggatcccacgactcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggcctt

SEQ ID NO: 183627 - DNA, 4510 bp, Homo sapiens
  Payload ID: 16176
  Gene Symbol: SLC26A9
  Gene Name: solute carrier family 26 (anion exchanger), member 9
  Uniprot ID: Q7LBE3
  ENST ID: ENST00000340781
  CDS Start-End: 3-2666
atatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaa

SEQ ID NO: 183628 - DNA, 4616 bp, Homo sapiens
  Payload ID: 16176
  Gene Symbol: SLC26A9
  Gene Name: solute carrier family 26 (anion exchanger), member 9
  Uniprot ID: Q7LBE3
  ENST ID: ENST00000367134
  CDS Start-End: 115-2778
gagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtg

SEQ ID NO: 183629 - DNA, 4799 bp, Homo sapiens
  Payload ID: 16176
  Gene Symbol: SLC26A9
  Gene Name: solute carrier family 26 (anion exchanger), member 9
  Uniprot ID: Q7LBE3
  ENST ID: ENST00000367135
  CDS Start-End: 115-2490
gagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctgtgagggctcagccagtcctcatgctgcctacagagtgcctggcacttgggacttccataaaggatgagcctggggtcacagggggtgtcgggcggaggaaagtgcatcccccagagcttgggttcctctctcctctccccctctctcctcccttccttccctccccgcatctccagagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaa

SEQ ID NO: 183630 - DNA, 2389 bp, Homo sapiens
  Payload ID: 16177
  Gene Symbol: SLC26A10
  Gene Name: solute carrier family 26, member 10
  Uniprot ID: Q8NG04
  ENST ID: ENST00000320442
  CDS Start-End: 312-2003
cacaagctctagagggcttccgggaggaggcttagggagctgggaatccgggagcagatggtgggttcctaccgtcgagggtgggagagagggatctgaggccaagtttgaggtaaggactgtggagctccatcagatccccatccccacctcccctcatctgcgcaatcctgcgagaagccttagacaggttctggctcagagaaccggagagaggcacaacgcctggcccccaggacttggccacagcgtccctgaccttgtctgctccatgacctctcactgaggcccattaacccctcagttccctgatgaggcttgatttagcatccttgatgtcagctcctaagagtctgggaagtgcatttaagtcctggaggttggacaaggccccctccccacagcacacctttccatccacttctatcccaggcatggcttttgctctcctggcctccgtgcccccggtgtttggactctacacttctttcttccccgtcctcatctacagcttgctaggtactgggagacacctgtccacaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatgctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgcttctggcctccgtgctctgcttcacctcttctgtggacacaagataccaagtccagatagtggggctgttgcctggaggatttccccaacccctcctccccaacctggctgagctgcccaggattctggctgactcgctgcccattgcactggttagttttgcggtgtctgcctccctggcctccatccatgcagacaagtatagctacactattgactccaaccaggagttcctggcacatggtgcctccaacctcatctcctccctcttctcttgctttcccaactcggctacgctggccaccaccaatctactggtggatgctggtgggaaaacacagctggcaggcctcttctcctgcacagtggtcctgtcggtgctgctgtggctggggcccttcttttactatctgcccaaggctgtcctggcttgcatcaacatctccagcatgcgccaggtgttctgccagatgcaggaacttccacaactatggcacatcagccgagtggactttctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagttgctgagcctgtcagggtggtggtcctagacttcagtggtgtcacctttgcagatgctgctggggccagagaagtggtgcaggtgagggagaggctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctgttaaggggcagtagcaccaggagcgggagccaggaggcactgggctgcggcaagtgaggcaggggtaagtggctggagacccagggagaggggtttgggaaagggtctgaggaagatcaagaagaaaagggtggggacggaatgaatagtagattgaagaccaaatcagggagcccgggctgagctatgggtgaggaactgaagaactcagatccctaagtaggtggggtacccctgagaggactgccacatttcattaaggaagaggggtgcctaatctattcctgacatgtctcctctcttctccaggagctcactgacccaaagatttgcaccgtgtgggtctgacctcatcatgtggagtgcagagggccctgatgacatgtgtgtgatgaggaccatgacccttgaacccccttacctaacgtaactaataaaatgaa

SEQ ID NO: 183631 - DNA, 1819 bp, Homo sapiens
  Payload ID: 16177
  Gene Symbol: SLC26A10
  Gene Name: solute carrier family 26, member 10
  ENST ID: ENST00000440686
  CDS Start-End: 1-1237
ttttgctctcctggcctccgtgcccccggtgtttggactctacacttctttcttccccgtcctcatctacagcttgctaggtactgggagacacctgtccacaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatgctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgcttctggcctccgtgctctgcttcacctcttctgtggacacaagataccaagtccagatagtggggctgttgcctggaggatttccccaacccctcctccccaacctggctgagctgcccaggattctggctgactcgctgcccattgcactggttagttttgcggtgtctgcctccctggcctccatccatgcagacaagtatagctacactattgactccaaccaggagttcctggcacatggtgcctccaacctcatctcctccctcttctcttgctttcccaactcggctacgctggccaccaccaatctactggtggatgctggtgggaaaacacagctggcaggcctcttctcctgcacagtggtcctgtcggtgctgctgtggctggggcccttcttttactatctgcccaaggctgtcctggcttgcatcaacatctccagcatgcgccaggtgttctgccagatgcaggaacttccacaactatggcacatcagccgagtggactttgctgtgtggatggtcacctgggtggcagtagtgaccctgagtgtggatttgggcctggctgtgggtgtggtcttctccatgatgactgtggtctgccgcacccggagctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagttgctgagcctgtcagggtggtggtcctagacttcagtggtgtcacctttgcagatgctgctggggccagagaagtggtgcagctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctgttaaggggcagtagcaccaggagcgggagccaggaggcactgggctgcggcaagtgaggcaggggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatcc

SEQ ID NO: 183632 - DNA, 2173 bp, Homo sapiens
  Payload ID: 16177
  Gene Symbol: SLC26A10
  Gene Name: solute carrier family 26, member 10
  ENST ID: ENST00000474359
  CDS Start-End: 10-1572
aagggcagaatgagcgggattcagggcaccaggacctacccaggcgcgggggacacctctgaccttaagtaccccttggcgaccaggctcagggaagctctcaccgaggctcggttccatcagctcttcaggggcgaagagcaggaaccggagctacctgaagagcgcggctttccccggctcttcgggctgtggaggctgcgggctcgcgcttgttccgggacaggggcgtggcgcctgctgctggctcggctgcccgcgctgcactggctgccccattaccgctggcgggcctggctgctcggagatgcggtggccggagtgaccgtgggcatcgtgcacgtgccccagggcatggcttttgctctcctggcctccgtgcccccggtgtttggactctacacttctttcttccccgtcctcatctacagcttgctaggtactgggagacacctgtccacaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatgctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgcttctggcctccgtgctctgcttcacctcttctgtggacacaagataccaagtccagatagtggggctgttgcctggaggatttccccaacccctcctccccaacctggctgagctgcccaggattctggctgactcgctgcccattgcactggttagttttgcggtgtctgcctccctggcctccatccatgcagacaagtatagctacactattgactccaaccaggagttcctggcacatggtgcctccaacctcatctcctccctcttctcttgctttcccaactcggctacgctggccaccaccaatctactggtggatgctggtgggaaaacacagctggcaggcctcttctcctgcacagtggtcctgtcggtgctgctgtggctggggcccttcttttactatctgcccaaggctgtcctggcttgcatcaacatctccagcatgcgccaggtgttctgccagatgcaggaacttccacaactatggcacatcagccgagtggactttgctgtgtggatggtcacctgggtggcagtagtgaccctgagtgtggatttgggcctggctgtgggtgtggtcttctccatgatgactgtggtctgccgcacccggagggtgtagtgcctggcacttggacaggctgaggggacagagctctacagaccactcagaggaagccccaggctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagttgctgagcctgtcagggtggtggtcctagacttcagtggtgtcacctttgcagatgctgctggggccagagaagtggtgcagctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctgagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagc
